United States Patent 10,900,036 (RNA INTERACTOME OF POLYCOMB REPRESSIVE COMPLEX 1 (PRC1)) - sequence listing, part 5

SEQ ID NO: 9171 - DNA, 1945 bp, Homo sapiens
ttttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgcc

SEQ ID NO: 9172 - DNA, 1350 bp, Homo sapiens
ggagtggctagactgagtgatttcttaagtcttttttagctcaaacattttatgattctgagattataaataatacattttatattaagttatattaaattacccagctgacttagcctgataatctgtatttctcttttctttcttttacaaaattatatagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattagatttaatgaaatacagaagatacacagaataaaaagggttttcctgtggttggtttgtggtttgtgataggtgttctgtgatgtttatgctttgaaggccttaagactcatggttgcaaccatggaagcaaaatgaaatttttagctc

SEQ ID NO: 9173 - DNA, 1253 bp, Homo sapiens
agtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgttctccctctcttctcatgcatggtcttaccagaaaacacaaaagctcgaagtgatgaagtcactcgatgacattctaggagggctgagagcaaatgctcaccttatttctctctaggactgtggagtcaaactgcaacctggcttacggtttttctgggtcattaatagaaaactgaaaagtggtaaactgtcaatcactcttcatattgtactctgtcaggtggatgcagatatttaagatagtttttaaaaacttgaaagtgatataaattcttacataaactgtacggcaatatgcaacaaaacactggcaaaaacaattgtaattgccatgaactcaccgttttagtaattacttattaagcactgactgtgtgccaagcacttagaatagggctgtgaataagaaagatgacaattcctgccctcaccatgtgaagtcttctaataattcctcactgctttttatacaagtccaattgcatattttgtttcactgctacaatcaaacatcaaagacgaagagg

SEQ ID NO: 9174 - DNA, 1293 bp, Homo sapiens
gtagcttccgagtccctacttggccaagggccggcacggaggggctgtcgatctactgggcacctaatagccgcacattctgtccagtccctggcgccggaacgtgaaggcccgggtcctggctgctatccgggatccggacgctcccttcggcttcggcctggtgctccaggccgtaaggcaaaggcggcggcagcagcagcggcagagaaagaagctgggtaaggcagtgacgtcatctgtggcggcccctcccccgcccgccagccctcaccgcagttcctgcccaacgacatccgggtctctgtagctgcgcgccgcgccgcagctgtagcggcggcggagccagcggggcggggcgagcggaggggtgggggaggggcgacgcggtcgtgagcgcgcctgcgcggggccgcgctagaggcggcggcggcggcggtggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccgggtaagtgcggcgctcgggccgacggcgggctggcgggcggtgcgggcctgcgcggcggcggcggcgggcaggcctggggcctgtaaacaagccgggcgtctgcccgggcgctcccgggaggagacgcgacaactccaccccctggccggcctcctcccccgagccgggcggcggacggcgaggggttaacgctcggcgagggcggtggcggggaggcgggggcggggtgttagttgcggtggcgcggggagggggcgcgaccctctggccgtccgcggccgagatgggtgtttgtggcggcgaagcaggcgacggccgcaggccggcctggccggagagcggcctgcagaacttttcccgagcggggagggggcgtccccgcgcccccacccgctcgggcgcgccgccccggctgtc

SEQ ID NO: 9175 - DNA, 1228 bp, Homo sapiens
tctctcctgtcttttggagtattggttatactgtattctctctatactgttcgggggagggggagtcattgcacacacacacgcacgcatgcgtgcacatatgtatttttttctccctgaaagtaacattttcactagaacaagtataactgtaattggcacagctgtaaaggttctcaaggctttgaagagcaaaaagaaaactaaaatattctcaaatttttttcttcccagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaa

SEQ ID NO: 9176 - DNA, 1275 bp, Homo sapiens
tatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaa

SEQ ID NO: 9177 - DNA, 1629 bp, Homo sapiens
tcattaaaaaattctttttagtagatttattgattgagtaatacatttggacagcctcatcataaaaccgcatttcaaatattttccaaaacaaaacaaaggattaacaattctttgaacagattaaacattgctatttcatatgtacacatatatacttatatactttaaaaaacatttatattctaaaagtcatctttacagaacattatctttctccattatccagaaagtatggtgtattttggcaccgctaaattttaacgttgttccttattttgcttccttttacaaaggactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgata

SEQ ID NO: 9178 - DNA, 1186 bp, Homo sapiens
cactattctacaaaatgacataaaggaaaattagtattcagattctcaattattgtagagaaagtagcataacagatttatagggtcaaaaaaagtgtgaaaatgtaattaatcaatgagagcaagattgcttaaaagtacatcatttttcactttcaaggagatagcctatgtaattgttcacccaaagagcatattgtggaaattttaaaagaaaaatcattcctagtcttttttttcatcaattccaatatgttctggctgtcatttactttttcaggtagaagtggaagatggaactggaaagaaaagaaaaaattggataaatatttatttttctatattttgatatatgttttagtattactttcaccagttattcttatttcagttattttgtctgtgcaatgttaacatcatggattaataaggtattttccacctcatgcatttttatgtatgtcattaatgcagcagcatttgttttatagttttctgttactttgaatttgcaggctatatatactgaacattttgggaagtcagtagaaaatgatagtgatgaagtagaagagagagctgagaattttccacgaacgtctgaaattcctatatttttaggaactcccaaagctgtgaaagcacctgagtcattggagaaaataaaattccctaaaacccccccgttcgaaatgtaggattttaattaataactattgttaaattatttgtatgttgaattacataaataactgataggaatagtaaaatgcttagtacctttaacaagtttttattatgtagtatttcagacatgcaaagaagagaaagactaatataacacacctccatttacccatcaccctgttttaacaattattaatacctgttttaacaattattaatactctgctgttcctgtttcatagaccctcttccccatttttcctgcaacatttagctgaagatggcataaatcccacgtacttataaagcaatagtgtgtagatttgagatttttccaaaggataaagaaaatttaaaatgtcaagctaagcctagcatagtggcatgtgcctgtagtcccagctatttgggaggctaagggaggaggatcccttgagcccaggaatttgaatccagcctgagcaacatagtgagactctattaaaaaaaaaaaaaaagt

SEQ ID NO: 9179 - DNA, 1214 bp, Homo sapiens
gttcttttctattctttcagttgaataagggccagttggtatgcagcccatgtatatgtgaatggagtaagataaaccccatgatctccttgcacagaattgcaaatgtcttttgccataccaagggccagactcagaacccttggagtcatgtggcagaatttccctcttacataaaccaatgcttgaaaatgctgcaaatgaccctctaatgatccctgaagatcaaaacaggggtaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcagtgcctttcttgtgttatgaaaggcaggtagatattatagccataggtaaaaatccatagttaaattgcacactgaccttaaatctctctgtgtatgcccttgtatcttgcatgttaaaagttggattattgggcatgtgtggcagcctgccctgctacatgctagacaagtgtgctttagtacatagccacaagttcttcattctttaaaatgttttgacagatcatctcataataaaaataattcaggaaaactatggggaaatagttacatttcacaaaagatattttaaactctttgtaaaacttagataatagagcctagcagttactttgtatctaattgatacattttatgttaatttaccaccatacattttattaatcaaaattgtatagcatgtgactcttttggctttcagagttctcaaaaatattattttgttgcatgtactgtatgtttagaggcaaccaattatatactcaatatggttttactgtgccttacacaaagagaaactctatacagaatgtatatcatggggtggggtaacagagtctttactgcactgttaggtgatggcacacagagcatgtcccagaacatttctgtgcttaattacccaaccaaagagatctgaagtatgtatgtcgtactgtaatgggggtttatgcctggacaattaagtgttttatttgttttctgaaatgatgtgaacttatttttctaa

SEQ ID NO: 9180 - DNA, 1808 bp, Homo sapiens
tttccaacaaagttttactttttgtaggattttaaaaataatgatttttaccaggaatctattaaggtcaatattaataacactgaaacaggaaatctaactcccaatattggaattttggtactttttttcacatccttgttctttatttagcaactctgattcatttaaatatgttttttatagaattctatgtgcctttttacctcgtggcctttttattggtagtaaggtacagaagtgtcaacagaagcactgatggttcttttctactatctaacagggttaatttcaccacaaaattgctttaaatctgaagaacttaagtttcactaaataatatatatgacatttatcacacaaatggataaacaactaattattgttgatacttttcattacaaggaaaataagttataaataccatgtcaaattgattatacaggctatgaaaaccattttaaaggaaagaaaatatgtaaattctattgagcaaaattctgtcctgttgaaacttagttctaaaggttttgaatcagttgttacactctgacacatgactgttgtttgcactatattatcatgtcttctttaaaagtaaatatttttggtttctgtaagaagcttgtttaataatgttgtaagccgtggctatagttttatcaagactctgaacacaagatgtaacaatgcaaataaatttatgtagtgagtaaagttgctctctagtctctgaaaagcaaaaaaagtgagaaaataatttcttcagagataacttcaagttgttgaacataaaggtgttagatgttagcacatcttgctttttttttttttttgagatggagtctcgctctgttgcccaggctggagtgcagtggcacgatcttggctcactgcaagctctgcctcctgggttcacgccattctcctgcctcagcctcccgagtagctgggactacaggcacctgccaccatgcccggctaaatttttgtatttttagtagagacggggtttcaccgtgttagccaggatggtcttgatctcctgacctcgtgatctgcccgcctcggcctcccaaagtgctgggattataggcatgagccactgtgcctggccacatcttgcttttttttttatgatcagaacaaagggcccactctagttctctacatgtcaatcaatcaagcatgttgaataagggacatagaggatttaacttttgttatcataaatggaacttgcaggcatatatcaagaaccctatgaagaattcctctcccatcattttgataaagaactacatcatttttgatagaattggtgaatgttcctaaactgctgaagctacatgttttttgttttgttttacaaagtcaggtgtttgagagttcttttccactctactactactcatagagcttgttttttctttgggtgtgtgctgatcctgttactgagattaattacatggctctgcagtgtagtttacataaaaatgatgttttccacttgattgctgcagatatcaagagtttgttattttcaaatacccatccaacaagagagatggggaggtttttagttatatatgctatatatatatatataactggaaatgttttatatgttttccgaaaatacaataagcctctcttttattcagtgttcttcctcttttctcccttatgaaaaagaaaagatagcacaaaacttaagacttacctaggaaacccattcatattcccaccatgatgtaattataaccctacaattacttcaggtagctacacaatataccaggtaagaa

SEQ ID NO: 9181 - DNA, 1457 bp, Homo sapiens
tgcaaggaatgagacaatatattcttggaatattaaagtacttttgaagtaactcatacgttttctcccctcttccatttgtttagctattgagggtttgctttaaaacaaatttatgtagaaatatcagtactataatagtattgtgatactgtgtatttcttaagcatatgccaggaaggagagcattagttaggtgtccaaaaaacagccaacaaaacaaatcagctctgaaaatcgtgaagcagtgaatattttagaattatttttgaaacctctttcagaactgtttttagaccccgtggtaatttgctatgtaatttaatactagtttaggcactccatgtacagttggtatgtttccttttgaaagataataatctatttataataaaagtctgaatatttcaatctcggaattcctctttaaaacttgaatcagttttactattgctttttaaaatgttacctatttatatttgctttgtatatcaatgctacacttcttgttttgttttaggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaagttctgtggtttttctcttattacagtgttttacttgaacacattttaaataccattttgattacaacatttactgttaatatccaagtctattatttcttctcataaaatgttcccctttttcctaatgtcttgttaatactagtccagacaagtggatatatttcctttgaccaagttatggcaagaaaaacctgacccatgataatgtcattccctcaatactaaggactcaatgcctgttttaagcagtggaaaatgaggcaaaccttgatcaaggtgttatagttcccagctgtgagccacactcaggataaaacaaaacccagcattaacctgctttagtgacacattcaaagaagttaataaaatttaatacttaaatgatacctttcacctccaatgtaagctcattttatgatgaatcctttggagactggagaaggtacattttaagtacagttccctatgtataaattgtatac

SEQ ID NO: 9182 - DNA, 1121 bp, Homo sapiens
aaaattgagtgacacatctaccatggctcccttttacaaacacaaaactaaataaggagggaagcttgtttgctgcatagaagtactgtctgcaacttggctacccagcatgaagatatgggtggtgtgttgtttcaaaattgtaggtcttgccttgtctatctggtgacataagagtataattaagccagttaattggcctgtctgaaaaattcctcatgtgatatggtaactactttatggccatggccctataggattgagatggagagccatttggctttaaagagatgactttttctcacgaataagtctaatgcagtatattaactggccttaggaatagcataaacaccaggagtctaattaaaatgcctttaaatgcactgttgtttggctcttacagtagtaaacttaaatgtgtatgtgtttgcctgtgtgtatacacaacctatccaatatcaatggttaggatttaggaccaaggaaattaaccaaaaagcataacaccttttttcaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctatagagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatca

SEQ ID NO: 9183 - DNA, 1472 bp, Homo sapiens
cattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttgatcagcttttatgttcaaatattaataatatttgcttcaacacctccaactcataaaattgtttaccaacaatttaagcacttatgaaaattacatggtactggttatttctacatttatcttagtgccatcaccttaatgtatgttgagtccctaaatgtcatgttaaataataacaaccataatatcccattgaaaagagtatgttgttagaaaagaaacatcatttttaagtttctgagcctattaaaatgctcaaacacaaaatattagtatttttaaaatatgaatgggatgagtgaagca

SEQ ID NO: 9184 - DNA, 1121 bp, Homo sapiens
aagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaa

SEQ ID NO: 9185 - DNA, 1527 bp, Homo sapiens
gaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaacaaaatctagggctgtattttatatatatatatatatatatatatatatatatatcttattggctctctgctttgtatttaaatgaagaatcttacatcttgggtaggtaaactgctgataaaatttgtgtacagt

SEQ ID NO: 9186 - DNA, 1563 bp, Homo sapiens
taggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaaggtatgtgtgtaaaagtattaagagggtactttcatggttgtgcatttatgttttaagttaaataagaagttttaaagtaagtagtaataagcctacagttttaattttctttgttgggagttttaaaaatgaatggattttatccctggatcatttgctgttattttgcttgaaagcagaggatagattaggagaccactgataatacctatgaatgttaagctcttggacttattttcttagctataacatgggggttaaaatattttcttgcaccagaggacaatgaggagacgagtgagttcagtctcattatagctcagtgcagagtacacgtaagagataatataatcaggctgggcgcggtggctcacacctgcaatcccagcactttgggcggttgaagtgggtggatcacaaggtcaagagatagagaccatcctggccaatatggtgaaatcccgtctctactgaaaatacaaaaaattagctggacgtggtggcgcgcacgcctgtagtcccagctcctcgggaggctgaggcaggagaaattgcttgaacccaggaggcggaggttgcagtgagccgagattgcaccaccgcactccagcctggcgacagggtgagactccttctgggaaaaaaaaaaaaagaaatcatacaatctatgctttgaaagttcaccctctgatgaagccactctcctttccttactcaatgcagggagagtgactcatgttgttagatctccattctgtctttattctcaggcagtcaactcattgaaaggcagtgaggcaagagtgtgtcttaatatcacttagttctcctgggagttatcattgaggtttttactgagttccagctcagctgtaaaacctacagagcataagttacaacaagatgggaagttcctggaataaaaaggaacatttatataattttttaagcctacatttctgaaaggtgtatatttcagcattttgtgttttcattgtgtgatagtttttattgctttgaaaatattatataaatctatcatgccatctcatctgccagtgcttttctgattttatttttagtatttatttactctatctggaatttattttcttgaaaaaaatgaggtagaaattaaatatttaaaaattttttaaataatttaaaaattttagtgaacatacaagcacactgaaatatatttctattaagaaagaattaagtagatattcattggatcaaaatattggatcaagatgtattctaaagtaagaaatgaaagttcctaaactgtgtggataatgagataatgtaatctcatttgtggtttttaaacagagttgtatttttatatgtaatacatttatattcatagaaaaatatctgtaaagatatacc

SEQ ID NO: 9187 - DNA, 1148 bp, Homo sapiens
atcacaaggtcaggagatcgagaccatcctggctaacatggtgaaaccccgtctctactaaaaatacaaaaaattagccgggcatggtggcgggcgcctgtagtcccagctgctcggaaggttgaggcagaatggcgtgaacctgggaggcagagcttgcagtgagccgagatcacgccactgcactccagactgggcgacagagcgagactccgtgtcaaaaaaaaaaaaaaaaaattaagcacacttaacctgggtagtcaagaccttctccacttgctcatctctttcttctcattcttcctcacacctgtgactgggacgttactgaaataaaagagatgactttatattttccctctgggaagtattcttccttccgattccaaatcaattccataccgttgaatgtgtgatcccactttgaagcaggattggcagctcagctcacggtgtcctggtttccacagggcactccagtgtttgtccatgctggcccgtttgccaacatcgcacatggcaattcctccatcattgcagaccggatcgcactcaagcttgttggcccagaagggtttgtaggttagtgttttttgcaaaaccagtgaatagactgtatgtttcttttaacatcaggggaattgggatggcatttttactgttgctttcctctttacagtgacggaagcaggatttggagcagacattggaatggaaaagttttttaacatcaaatgccggtattccggcctctgcccccacgtggtggtgcttgttgccactgtcagggctctcaagatgcacgggggcggccccacggtgagtggtgggttgaagtatctgattatcggcagtgtgctgacggccaaaaggaagttggatgacttctgcctgtttcttcattgagttgctcttatcctcgtgattaacaggcagcaaaagcaagggacgggcagacagcccttgtgttggctgccttatcactcacaggcaccgtcagcgctcagcattttaagagggccaaaatcggctgcctggcctacctttcggaggacatctgacaatatctaaacccctccaaggacgtgtactcggctagccccacaaaaaactgttttacgttcagactgttctttttaaatctgcat

SEQ ID NO: 9188 - DNA, 1128 bp, Homo sapiens
tcaaaaaaaaaaaagttcttccagctaaaacctttattttttgactacatctccacaaaatggagctatactgttagccagtatcctaatagtatagtgcagtttgcataatgattaccaagcttgaaactggaaatgtcatatgcactttcgtgtgtatcaggcagatactaaacattttccccttgagtcagcttaaaatttttccttcttttgaaatctcacgcagttgttttctggagaaaaatagagactgttttagtatttgttcttattagcgtatcatcagaactcagcacagtctgccttataagaaaacaaaaaatttttttatttataactcttgagattgttacttcttgctctttctgatttcccatccgtaaagtgggtgtaagcaatacttacctcacaggggtgttgtgaggatttatattaaacgtgttaagttctctcagtattattgattaaaatcaaccatataaacgacatttattctgtagctagacctattaactttagtatttcagcctataaattctaaaatgttcttaaaagcagtaatgtactatctaatattcaataactaattgacagaactcattgttattttttacaaataactagaaacaatactgttgctagaattcctgttctactgtaatttaatcatcactgtttctttttagccttcagtaaggaggatactagttctttggcattattgggaataaaactttgtcaatttcagctttattgaaagttctcccaaatatattgtttttgtttacacaaaggaaaaggaacaaaaacaataaataaatacctttgtttttttttcttttttgagacggagtctcgctctgttgcccaggctggagtgcagtggtgcgatctcggctcactgcaacctccgcctcccaggttcaagcgattcttcttcctcagcctcccgagtagctggaactataggcacgcaccaccacacccagctaatttttgtatttttagtagagatggggtttcatcatgttggcaaggctggtttcgaactcctgaccttgtgatctgcctatctcagcctcccaaagtgctgggattacaggtatgggccactgggcccagcct

SEQ ID NO: 9189 - DNA, 1221 bp, Homo sapiens
ttcatcaagtaatggtccaagaaagaagcttgagggaccagccaaattctctagagagcaggcaactgcttcggtaacctataatcaccaaggaggcaccctctgtccttcattctccttgctagttcaagttatggctgagacaatttaggtttccagattcttgttttaaataagagacctcactgcatctttcaagaatgaccttgaaatttttttaattaatttaaaaataattttatgttgtacatttctattaagaactaaccccactttttatcttccttaaccctgaagttcagtgggaaataattataaagaatctgtccaccctctgagcaactgggacccccctgcatccaaccccaaagccccagtgacatggcagcttcagggttgtgtagttccaacctagcagcttatctgaagcgtgcccataaatgaagcccatcccccactttgtcctccttccccctatttcttccagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagagg

SEQ ID NO: 9190 - DNA, 2148 bp, Homo sapiens
tcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagat

SEQ ID NO: 9191 - DNA, 1878 bp, Homo sapiens
ccttttcttctctttgcagcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttctatgatgtctcttatttgtgatctgtaccaagaaaatgcccaatggtaggagctactaaaggttgctcagggatcgtcagtctcctgtgtgcaggattccagactgttcacatcggtggtgacagaggaatgaccgagttccatcctcacatgccgtctcctccagtagaggaagccgtgggcctaacagagagtgggaagagatgttttccaagctccctggggtaattcggtatgctatgtcccagccctccacacactgcacttcatggtctgtctccgacagacagcaaggactgggcctagtagccccagagcaggctgacttagcaagggtgggtggatgtctggccagaggcaggggctgtcacagggacaggctggaactc

SEQ ID NO: 9192 - DNA, 1878 bp, Homo sapiens; identical to SEQ ID NO: 9191

SEQ ID NO: 9193 - DNA, 2153 bp, Homo sapiens
aaaagagctttgaggtccttggagtggaatgtgctgtgtaagtaccagagactccaggtgttcagggacagtgagccctccccattgtcaatggtagtccaatcagggcagcctatgggctaggcccatgctgttctcaatgctcacacccgccttttcctacaaccacaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaatgggttgaccttccaggctcaagctgagctgaaccaagggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgc

SEQ ID NO: 9194 - DNA, 1188 bp, Homo sapiens
agttaagtggtataatggcagctgaacaatgagggaggagagtggagttgagaactggtagaaatgaaatcactcatacagggaacatgttttttcttgagataatgaacatatagcccaaaatatgtggttgagtacattttgtttttgattgattgttcaaagatataatttttaagtcttcatatataagttaatgtataattatgcaagaaggaaaagaaagtgatgatggcactttgaggactttcaggcttagagctaattagtctgttatctggtagagcactaatgtacatggctgatttaatatacagattaacagatttaaagcttttaccctttacttgttattaggcagttaggttatcttccaacttgttggccagtcaacaccaatgtgtttcctccaagaatctcagtatatgctattttatataccttaaataatttaaatacatttcttactctttccacagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggtaggtcctaaaatactgaatgaagaatgatgaaatattgtactttgtttttaggtgtagggcttcattccgctaggaaaaatagttaattatttttataacctgctgtctttgccacaacttagcatgacagttttctatctctgtgtatttaatacagaacaagcttgtccaacccacagcccatgggccacaggtgacccagaacagctttgaatggggcccagcacaaatttgtaaactttcttaaaacattctgagatttttttattttttttt

SEQ ID NO: 9195 - DNA, 1429 bp, Homo sapiens
agtgtttatatactaacaatttcttttaaattctttcccaaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttatttactttgttttttttcctgtttctgatatagtaactaattcttaactcagagacattggtccattttaatactgaaaaccaattttcattggtacacattacaaaattgctaagaacactgtttgggagctttcattctcatattttggacattgttttaattgagtgaaataatcataactccttgctcccagagaagctatcacctccatttctaaaaccatttcaggttt

SEQ ID NO: 9196 - DNA, 2068 bp, Homo sapiens
ctatcattaactatctttaaactgtcccaagtgcacgttgtacctgaagttgtcataaccggtaggacataaaaactttaagcattcagttcgatcggtagcgggagcggagagcggaccccagagagccctgagcagccccaccgccgccgccggcctagttaccgtcacaccccgggaggagccgcagctgccgcagccggccgcagtcaccatcaccgcaaccatgagcagcgaggccgagacccagcagccgcccgccgcccccgccctcagcgccgccgacaccaagcccggcactaccggcagcggcgcagggagcggtggcccgggcggcctcacatcggcggcgcctgccggcgggcacaaaaaggtcatcgcaacgaaggttttgggaacggtaaaatggttcaatgtaaggaacggatatggtttcatccacaggaacgacaccaaggaagatgtatttgtacaccacactgccatgaagaagaataaccccaggaagtaccttcgcagtgtaggagatggagagactgtggagtttgatgttgttgaaggagaaaagggtgcgaaggcagcaaatgttacaggtcctggtggtgttccagttcaaggcagtaaatatgcagcagaccgtaaccattatagacgctatccacgtcctaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcagaggccctcctctccaaagacagcctagagaggacggcaatgaagaagataaagaaaatcaaggagatgagacccaaggtcagcagccacctcaacgtcggtaccgccgcaacttcaattaccgacgccgacgcccagaaaaccctaaaccacaagatggcaaagagacaaaagcagccaatccaccagctgagaattcgtccgctcccgaggctgagcagggcggggcttgagtaaatgccggcttaccatctctaccatcatccggtttagtcatccaacaagaagaaataatgaaattccagcaataagaaatgaacaaaagattggagctgaagaccttaaatgcttgcattttgcccgttgaccagataaatagatctgcattatctatgcagcatggggtttttattatttttacctaaagacgtctctttttggtaataacaaacgtgttttttaaaaaagcctggtttttctgaatacgcctttaaaggtttttaaattgtttcatatctggtcaagttgagatttttaagaacttcctttttaatttgtaataaaagtttacaacttgattttttcaaaaaagtcaacaaactgcaagcacctgttaataaaggtcttaaaaacaaaacaaaacaaaacaaaaaaaaaactttaagcattcagaacccagatacaaacttctgcaattgcctcagcaatagtctaggtcatgtggtacccaatccagtgtttttaaaaatgctactaaactacaataaagaagcatctttaaagccttcttacttggaagaagcaaaaggccacacatcttttttctagttcttccttctattgtgaaaataactgaaatcagatgtggaaaagaatatggctgcacacagaaatgaattactttgtcagccaacgatattaaaagatgcatagaaaacattgttgaaggttagaagaaatgcgtctagaacaagagtgggaggtttgtaagacttggggatgaaaagatgttatctaaatgaatggtattgctaggttctgtttccataatgactgtagaagaactgacttcgtgagtcaataaaaaaaaaaaagaggcatgaaagaagacatat

SEQ ID NO: 9197 - DNA, 1159 bp, Homo sapiens
tattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatgg

SEQ ID NO: 9198 - DNA, 1340 bp, Homo sapiens
taaataaattactgaaaatgaaattaataaaagtaccaggtttttttctaggtatgtgtttattatccttgttacaaaactcaaagaaatcaaatctacttaatattgaaacagtgtttaaaaaatccacccccacctgtattttacaggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttatgagggcattataatacttccttatttgctaattaagaaaataactagttcctattttagagtaagaaataaggtaactttttactatttataagtgataaaaacttgctttcatatatgaagatgaagcatttgagtggccacatcaggtgtctgaggtttttagtactgtttgatttggcatgagccatccatggggactcagtctttctcgcatccatttccaggcatttttgacatgattagccatggaataatgtttagttctgaaattgtgacactgtctttattaatactgta

SEQ ID NO: 9199 - DNA, 1297 bp, Homo sapiens
caatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaag

SEQ ID NO: 9200 - DNA, 1193 bp, Homo sapiens
tacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtggctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcc

SEQ ID NO: 9201 - DNA, 2323 bp, Homo sapiens
agtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttagacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgctcagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacgtatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgtttcttggcttcataacttcttggtgctgtcttgctcctaccctttgcatcctttttccttgtggaaagaaaagggagtggggaagatcagatggccttcaattcagacttagtctaaataatccccataatgactaatgactttgcttaggatttatctcatttcctatgtgtttaaacactgttagtgcaccctctaccaccagaaaacttttttttttgcttcagttgggggatgggtagagataggtaatacgtttataaggtgcaaaaggtaagtgaaaagtcccttccaccctgtccacccagcccagtcccctcccagaggccaccattgttatcagtgtctagtgtacagttccagagcaaatgactaaagtgttccactgtgaagctataccacaattatttaaccagtttctaatgatggacattttatgttgttgccatctttcgcc

SEQ ID NO: 9202 - DNA, 1199 bp, Homo sapiens
ctggaggccaactgaggagagttttttctcaattatttttaaaaggcttttcaaggaggaagaagccatctctgtcaaaagctgctgattgatcagatagaaaataaggatcaaggattaactgttagatttacagtttagtggtcactggtgacctaaggggcagtttcaatgggaattatgggtgcagagctagattagagtgggttcaagagaaaaatcacaggagggaattggagacagtgagggtagataaccctgtctaggggcttctctgtaaaaggaaggagagaagtgaagcagtcgctagaatgagattctcaaaggtatctgtgacacataaaagattaagaagcactgcattgggaggatgctgaaggttcatcaatagaaggaaattcagagtggatcccagacagtgccagaaccaggctcaagacttctgacttctcgccctgccctgctccaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggtaatggcagccccttcctgccttctacctctgttgctggtgccccaccctgcaggagaggcagtgcacgatgagggaatgagactgtcattggtccctggccttgctgtttggctgaccctagagcaaatccatgttgctctccagtattgttaaataatattaggatttccatcctaagtttgggggcagactttaatcctgtcaataaaggcattcttcagaaagcaagaaatgaacaggtaaaaaaaagaaataaatggtagtttcaagataagcatgaggcgtgaatgtagaattcataaggaatgatggaaacgttagtgtttttagagaaaatatgtgaagggagaaggaacacgttcctcccaatctgcctgaggatagtcagtactaaattgaattatttaatgccaaagtacaagtgaagccaatttgagtggagaatcagaaatatcttcttttagcatctcttcggtggtggaataatgtcctacccaagagctccaccagtcagtgcacttcaggatct

SEQ ID NO: 9203 - DNA, 1220 bp, Homo sapiens
acacacacacacacacacacaaaaaaaaacaattagctgggtgtggtgctacacacctgtagtcacagctacttgggaggctggggcgggaggatggcttgaacccaggagttcaaggctgcaatgagctatgaacatgccactgcattccagcctgggcgacagagcaagaccctgtctcaaaataaataaataaatagaaataaataaataaatgaaaaggagagtagggcgggttttatgagtagaagttggctctgggtagtcataaagaaatggcactggctgtatttggagaaggggacttgattttgatgcactggttctcttctatttagtcatctggtcccatacatattatctaatacctcttcaatttaaaccctgctcttcatctttcagcacatcctcttggctccgctttcgaaatacattcagtatctgattactttctaccaccttcattgccatcatcttggttcctggaggctaaaagtactggctttggagttagacgttggtttgaatcttagctccactatttgctaattttatgaccttgaataagtatttatcccagctctaacctttcgtttccatgtttgaaaaatgaggataacaatatctgactcatagggctgtgagtattaaatgagataatgtctgtaatgttcttcacaatgtttggcatattcagtaaaaagtagcctttaattattaattttactagttacctcgttccagatgcctggtgtattttatctctttcctcctaaaatattttttaacaaggctgcaagtgcctcagaaggaagaatcatgtcttattcactattgtatccccctctgtctgtcttactggtggatgctgttactgcctgaaccctcctttatctggttaacttacacttattttttggatctcagactctttttgtctttccttttcgattccacctacagcacttgtgtccaaaactccatgctaggaacaatgggataataaagatgaataaaacatagtatttgcccttaaggcttctacaaataaggtaattgtagaggcaaatcgctctctgtgatataatggagaataaaataagtatcttgtctactgttcctttcctgtttcttaaaatatgtaagtagcttgtaagtaacttctctgtctgtcctttgtttgggactatagattacacagagggaattaaagggaggta

SEQ ID NO: 9204 - DNA, 1484 bp, Homo sapiens
agactctctaagatctcttctgtgaactttagctgtcttcttttctctgaattttcagctccttctcctcacttcagggagcctgttggattccacctgtgttccctcttcatgcaacacaacctagaaattctcttaaggtaatggcctgaggaaattgtagaactttccttttttttttttttccctcatctcttaccagatgtccagtgtcttgaaaagacattgttctgtttgttttgtttcttgaaaagtattgttggttgttttaggtggtagggtaaatctggtccctgttacttaatctttgtcaaaagcaaaagtgctcagagatcttcctttaagttttcattggtagttctagaaatgaccaatcacaaaacagggaatctctaactgaaagatccatgacatttcattatagagagttaggaaagagaattaatctgagaattaccattatctagtcttcctcccactcatattcttcataaacatttgcataacacaattttttgtaccattgttgaccatatcaatgggtagattactgaattttggggggaaagacatgtacaagctactagaatggtaagttttgttgaacatgttatataaaaggaaattacgcaaggggagctgggttggtatcatagtatagtattatatttcttttttttttttttgaggtggagtctcgctctattgcccaggctggagtgcagtggcgtgatctcagctcactgcaagctccgcctcccgggttcacgccattctcctgcctcagcctcccaagtagctgggactacaggtgcccgccaccatgcccagctaattttttgtattttttagtagagacggggtttcaccatgttggccaggatggtctcgatctcttgatctcatgatccacccgcctcggcctcccaaagtgctgagattacaggcatgagccaccgcgcccggcctatatttctttatagaggtaaaataggtgtgagatttttgtttttacttattttgctttgttatttgggcttcactggggaaccaagtgatttttggcaagagaagaagcacaaaaaatacagaaaagcctcttcttatggttcctataatggcaaccaagtcaataaatggttgcaaaattcaactagattgcgatagggtagttactgctactgctttatccttttataaatagtcagtttgaaaagtagaaaagttcatgggtaaagagcagtagctagaatgcaaatgtgaatccaggatgcaatatacaaaggtttttgcagttttcagcaagtgtgaagaatttctgattgatgaggccctcagagcagaaagagaccctcctctgtctatgtgtaagattagtaacacatagagacgtggtgttcatctgcccagtttatgtggctaattagcatttagagtttcttcaatagaagctagtgaagtaagaactagataatatcttggaa

SEQ ID NO: 9205 - DNA, 1443 bp, Homo sapiens
cacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttg

SEQ ID NO: 9206 - DNA, 1629 bp, Homo sapiens
tgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatga

SEQ ID NO: 9207 - DNA, 1155 bp, Homo sapiens
aagagcatgggtactgaggaggtgagtgaggtctgccgaggctacgaggatcctggttcagtgggtccctgagatggacaagacttgggaaagggcatttgaatggcaagcagaggagtgaatatttaggttagaactgaccctgcatcccctttctgaggctgacaggtacccgagagttggtaggtatttcatccaatgataacagtgcttgttatatacctctgtggtgctgtttccatacctaagagcacccatgctaaaagtgtcttactaattaccagtgatggcctccttagggctgggatgggaactgagaatcatttgagggcttaataagtgattttggaggccccagtccccaccctatgggagcagagtgaggtggtctgacaaggtgcttccttcccggtgagcaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggaggtgggtggggctggccttgttcctcttcgggagcccgtggccccttctgctctttctcctgggtggggaagtctccaagggaacaggtcatagttggaggataaattaacttcacccctgaagcctcacatcttcaatttttagtaccttctgctttcccaaggaatgtgttgagaatgcacatttctaggccccatctctagaatttgcttcactaattctggggtggagttcagaataagcacttctggtggttctgggtgctggtgggctccaaacactggctcaggcatctgctttgaaaatggctacttgttttaactgtgcaagagtgtgtgtgtgtgtatgtgtgtgtgcgcgcgtggctgtggggttggaggttcggggaatcacacatttttttgtctcaatctttcctacccccaaatctgccctccttcctgacctgacccccattggcaagtcctggtttctttgctctcccaggcagaggctgccaccctgccccttggtcatctagggtccttgtcctagtaggttgtccttgtcctggttc

SEQ ID NO: 9208 - DNA, 1104 bp, Homo sapiens
ccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaaattgtttagtgaatacagaggaaaggaaaaacaagtattaaaggcacatgaaaccagggcctgaaattttgt

SEQ ID NO: 9209 - DNA, 1711 bp, Homo sapiens
aagcccagggtggcactgggttgggtggggacggatggtgtcttggcagcaaaggatgggtaatttgcaaatgaacatggatagaagagcagcaaagcaccaaaagaacaaggtctcttacccaggacacagtcccttccacactttaccagccccagggtctgagcccgacgctgcctcttccggtcctgtgcctgtgggtgcccacattcttagcaagaggctgcagagggatctttaggggaagattcgggcgtagtttattaaacagactccacttctatttggccatgtgtcaggctgagacctctctctcgggcattaatgaacagctagtgccctgtccctgccgccaggacccactgaaaggacgggtagccacacacatccctgagtagtcccagcctcatttgtcatttttgactcctgctttctcaaaggtttttgcctctgtcaatacagcatcatgggtggttggaaagaagggaacttcccttctggaccaagaacagcccctaagtcattagggttcaacctcacccttattcccctccccgctacaggagcccctaagtcattagggctcaacctcacccttattcccctccctactacaggagggattttcttgaagggtcagctattgcactgtgctgggaggctggctgtggctcctgtttgtgaagagaactcccagttccttttcacagccgctgagaacacatccacacatctaccccacggccttgtcttggaactgctcctgctatccccacaccctgcttcctcaccccactggctcttgggcaaatgactgttggtaccaggaccctgggggtctcccctacaaagcagaccagcctggggcagatatacctaccacaggagccccctgtctttcataggccaaggatccacatacccatagagttcatggattctagagggtctaggaatctcttgaaattgtccctaaaatactgcatgtgtgtgcatacatgcattttcctggggaaaaagtccatggcttctaaaagaggtccctgatccccaaagggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagtgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagccggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctt

SEQ ID NO: 9210 - DNA, 1242 bp, Homo sapiens
ttttagtagagacaaggtttcaccatgttggccaggctagtcttgaactcctgacctcaagtgatcacccgcctcagcctcccaaagtgctgggattacaggcatgagccactgcacccagccaatttttttgttgttgttttttaatcactaaaggaaccataaaaatagaaactatgtaggaggaagaacacatggtttctggtcatactctgtcaagaagtagatatgtaacatattgggcatttaacttaaaaattctaagtcatgttttctttttccactataagattgtactaggtgatataaagttcatgtcacttaaaattcaacgactgtgtaagtagctctttcagcttttcattaagttcatttttggaaatgtgcacatctatgccatcattgggcagttataatttggggatttaaacacctggcagtgattgaccactgtgactttgcttattccctttctctcctcagttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttctccctgagtgctttttttttttttgtctttgaacattgaattttcttgcaaagcattttttcattttaagtttaaaaaccaatagctgctacacaaagaatttgaagaaagtttaagtagtgcgcaacacattttgctgtgaagctaataacacttttacctcacttttccagcataattaaatgaatcttaattatagctccaaggtttgtacctactattgacgcaaacgttataaatg

SEQ ID NO: 9211 - DNA, 1168 bp, Homo sapiens
tttcatctcagtcaggcacagtggctcacgcttgtaatctcagcactctgggagaccgaagcgggcggatcacctgaggtcaggagttggagaccagcctgggcaacatggtgaaaccccgtctctactgaaaatacaaaaattagccagatgtggtggtgcacgcctgtaatcccagctacccgggaggctgaggcaggataatcgctggaacttgggaggcgaaggctgcagtgagccgagaccacgccactgcctcaagcctgagcgacagagcaagattctgtctcaaaaaaaaaaaaaaaaaaattcatctctttgttttacttggcattactcatgcaattgatcatttttcatcttcgctgtctattgtagatgttggtctcacaaatgagcagctcacagtcttgattacagatacttgagaaactttttcccattaattaatcaaagtttgcaattatttcttttgctttctccccaggaacgactgaagctggtgactgttttgggtgctggccttctctgtggaactgctctggcagtcatcgtgcctgaaggagtacatgccctttatgaagatattcttgagggtgagaaagggaagagcattatttgagatatgttattgacttggagggttagcaggatgaagcttagtggtatgttttctgagcacagttcatgtttaccatagagttctaccctgagaagatttgttgagagatatcttgatatctttgatattgacacatccttagcagtttgtcaactgaatgtcccaattcatgaataccacttaatgtttatttgccacagtgcatgaatgagtcattttaagttatgacagttcttttttaatgcttactcaaacacttcccaaatcccacatgatagtggctgcattttttgtttaatttaaaaatatatagatataaatatttaaatttaaggaccctttacagtaaactttatagataattgatgaggacccatgcagtaaaggataactgaaaaaattaaagaggcctttcctgaccctaatagcaacaagcagagggaacagtatagctgtgtgagagtaaatgcttggtggtcagcttggcttactcaccagcaaagtaatttggtccttcacacagctgaaaagcatacttgattcaca

SEQ ID NO: 9212 - DNA, 1115 bp, Homo sapiens
ataacttaaagttgctgtgttctctagatgtccccagtgtcctagacagcaccagttaagaacagtgagtgttttttaactgggacttcttcctgaccctgaattttacttgacttagtttttcctctttctctcttctaattcacagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagca

SEQ ID NO: 9213 - DNA, 1334 bp, Homo sapiens
catgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaact

SEQ ID NO: 9214 - DNA, 1424 bp, Homo sapiens
ctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaatctgagtggctcattacttatccttttggcagtttgtttgatgaccagaattgacctgtatttgaacatcagaaaagagaatgaaaagttgtgatggatggtagaaagatgtac

SEQ ID NO: 9215 - DNA, 2629 bp, Homo sapiens
gctctaattggggtgagagtgtagtccctgggcttgccctgggttgaccctggtggcatatttccttggctgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccgtgtgcaccccaaccttaatggcctgaggtgggcagaggggtgtggagcagcctggagtacagggccctgggggaggagcccactgatgaggggcgctctcccatagccatgtgttgaatgctaactaggctggggtggacgaactctgccaactgctgtcatcttagaagatagatgcagcagtaaggaatgtttgttttgcttttttctgaaattttctgaagcactgtggctgggaaacttcgaagcggaccctgtgctgcatgtctgctcctcccctgagcctgtctgcttgggggtggtaaaaataaaaatcccagtttattttcagtaccttacctaacagggttggctccaggcgtgggtggcctagaagatgaggggagtggtcttctcccagccttttaccctcttgcctcctgcctccgcgcttacacacgcactttaccacccggtcattccctggcctcttgctgccacttgtagtcttccttccttcctctcagggtaagggcagtgcctgctgtgcctgttggccactcccacacttcccctcccccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgtttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatcgactgaatcctggccactttatgagtttgtttggttttataaggcatttcaatgtacattctataaatacaagcactccatttgcaaacagatcttaagctaatattttctttccca

SEQ ID NO: 9216 - DNA, 2577 bp, Homo sapiens
cgcaggcgcggtcgaggcgtcgcgagattctggcttccacccgctgtgacgcgcccgcgaggccgccattgggctggctttgcggagggcgcgggcggctccgcccgcacttctcggcctttcctaactgcggcagatgggagggggccggagagcccggagagtgtgcggctgcgcagttggaaaggtggcagtgggcgttgcggttgctgcggtctgggcccagtagcggaccgtgttgggagggagctgggttttcattttgtctgcaggtaacctggcctcattagaggctctgttggcaatctcgttcataacatcactgtgtaaacattttatgccgttgatgtttttgattgtttaatcaggcgtttctctgtgacagtcattgctattatctcgattgaattactttctaataggaagtactagccggacatcatgagtggctgtcgggtattcatcgggagactaaatccagcggccagggagaaggacgtggaaagattcttcaagggatatggacggataagagatattgatctgaaaagaggctttggttttgtggtaagtatttagaactgggtgaattatctgctaagtaggtagagttttgataagcagttgttttcgatcttgagtccgggtggaatatttgccttcagaaaatgttacccagccttatgtctgaattttattgaggctgaaaacaactttaacttgccggctcactggaaccccactcccagtggctccttgattaggtttgactgtatggcagtgtcgttaagatactcttcccattctgtctcctgatttcagtgctcttaatgtgttgtagaatactcttctaaagccaatgttaagagtcttatgcttacattttaggaatttgaggatccaagggatgcagatgatgctgtgtatgagcttgatggaaaagaactctgtagtgaaaggtgagattcctgtgtaactagataaccctgggacatagagcagactgggtctgctggcatatttttctaagtagatttatgtagcttaagtgtgtaacggagatttttcttccctttttgtagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccagttgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttatt

SEQ ID NO: 9217 - DNA, 1161 bp, Homo sapiens
ctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaactactttttgtctgtttgtctgaagaagtcctatgctgattatttctcatccttatacagtagatttaaaacacagaacacatccagaatcctggagttggttacggtctctctttaaaaataatgtttttgacgtctccaggctagtgaaaagatacagaagtaagtgaatgccaaaatcacaattgttgagttttgtgtccgtggcccccctgtcccccaaagttctttctctatctcctgaatttattggcatcaggttacttaagcttccagagccaagaggaggatagtgtgggaagcagtgtttcttgcctaccttaaagattaggacaggtttttttgttttgtttttgagatggagttttgctcttgttgcccgggctggagtgcaatggt

SEQ ID NO: 9218 - DNA, 1293 bp, Homo sapiens
ccaggttcccactttctgtgtcatcatccttcagttgtggcttgctttctcaaggtcacaagatggttgctggagctccagccataacacttgctttccaggcaggagagagggaaaaggaaaaggccctcagtttttttttccccatggtagaagagccttgcattctttcaccctcctggttgcgtccctcctcgggctgcagtttgtctttaaccttcagtttgtgtggctactttctgcttaggagaaattgtcaggctttcccttatttcactaggaaatatccaggcctgtttatttttcactttaaacacaatttgaataagcctattactttcagttcctttgaaaactggaagcttcaaattagaaagtgggaggaacgatggctaatggctggcatgtggagacacagatcatgcacagtttgacaacgaagaagggtagaaaaaacccagattatagcttaaggccagtgagtgtgggggcaaacagctctgcatggcttcaaagcctttggcaccttgattgtgtggttctatctgtagggttgtcttgctgggtaacaaaatcattcctctatctctttccgctctgctagactgtgtgtcttctcctgtgggtgggaacatggtacattttccactgatatccagtgttctatgtactcttatacatgtgaattatgtactccttaccagcttcctaggaagacaaaataagcaaaatatgattggatgtttcagggaaccttagcattagggctgccagataaaatacagggcacctagttaaattcgaatttcagataaacaatgaattggcgtgtgtgtgtgtgtgtgcgtgtgtgtgtgttccaaacagtacatgggacacacttatactaaacaatatattccttgcttttctaaaattcagagtaactagtcattgtgtatttttatttggtaaatctgaccaacctacttggaatacatgagtgtcaggagaaggccctgcagttggtggggtagaattgatttaaatgaaacagcctgggcacagtggtggaaatatttgttgatccgattttgctcttgagtgtgggacttctgatgctcttctgaagcaagaggaaatcaatttcttttcatggctgctaataagctagctcaatacagcagccctgagaaaaaccctggctagagttttaagagtcctaggaatgacatgaggtttatgtttccttatctccttggctcattccttgcctgtttagagaagctttttagagtatatgtcttctgtctg

SEQ ID NO: 9219 - DNA, 1160 bp, Homo sapiens
tgatattctccatgggcagcaaccctgttccataagacagtgataggatttggttcttggtgcttttatttcatccagttggtccagattccacctggcgcatttgcttttcagcctggggtaaccacctctcaggaggaggcagcgtgcatgtagatgcctagtgtagcactcagaaactcattgcctttgactaggctgtagttcttgggggctgctgatgggtttgctaagctcatcatctacagtgtggccacacttattacccaggacacccagccccttcgttggcccaaatgtgccccttcttttccatccccactgctgccttattcaagcttagtaacctcctaagtgtcttctctgttgtctctcatacccttgccaaagatttccaaagctcggatctgagtttgtgttttacttccttcattggctttcagttttttaacaaaacaaaacaccaaagacagctgggaatttttaggatcctctatgatctctccccaacctggccctaggggctgatttcttctatgaagggtcatttctaaactctatcttgaaattactttgcttgtgtacttaggtgtacctgttgtgattctcttagcttgtcctttcaacatcccttcctacttgtgaaaatcttttaagacccagtttatggctccttccctgagaaattctcctggatcctttcagtctgaatttacctctccttctagccctacagaacacagtgtcagctgctctgtccagcactcagcagagccctgaagcataataggtgctcagtgagtctttgccaaatggatggttctttttccttcctccctgcctctcctatcctctcttttcctttctacgagtttgctgtgaccatctcacatcttggattgtctggcatcccattttcccatatcctatctgtttgtttgtgacttaggctttgcttcctggtttcaaaaatgcagccccagtggagatatgtccacatgtcagtctttgcaactagatcagcttgtaggggcagggcctgtgttcttgtttattttcataatcctcaatgtacctagcatggtggcttgtattaaagggggtgggcagagaaatcgccagaaacttctctgagtgcctatgggggtgtctgatgtgcc

SEQ ID NO: 9220 - DNA, 1115 bp, Homo sapiens
ccccataccctccctctacctgatacaaacctgagcacaatttcggtggctgactttgttctgtttgccagcgatgtttgctttttccttgccctggtagagcctttccttttctgggccagttgtctaccctctatttggaaaggagccctgagcaatggttctgtgggctctccccctcatcaggggctcccagagcccctgcataactctgagtcacatagatgttgagaaattgggaattgggaattggcgatggccaagtggcactgagtggtgtgcgtgatggaaagccatggtagcagggcagagtcggcccagcaaatggtgcttggaaaaatgatcctctgggggccacttagcccctcctgtgaaaaagtgcaaagtccacaagtaagaaaaataacctgttcacatagttggcttgaaaccataggtgctaaaaccccctgtggctaaataaacagcaagggcctgctcagtgatgtcccataaatcatggagtgcagcaacccttccctggggcaccacatctagtccctgtgctaatccttctgaaacagcaaagtcagttccttacaacctggtcctatctttctctcttttactcctgcagtgccttcctctgccaaattctcagccaccctacagttctggaacactcccgacaccacactctcacatgctcgcacgctgacctagagaatcctgaggctggagccatgtggtttcttatgcctctggaatttcatgttgtaatttagaaaggttgttttcaacacacagtttgatattttgggttatctttcagcatttcattcatttttgataagagactaggtgggtgtgaagtatttgatggggtttcagggtcactgtaggtgatacaatgctaattttttctttaatattcttggctcagtgggacaactccttttgcaatgaaacccaagtaagtgcctctcatttttcagtctgggtaacattttaattgatttttcccccaagaaaatccagtgcttgatggtctgagggttgagtgtagcatttcccaggatgtgtcaaagggatagatattctttttgcagcctctgtggtctcatccctacggttta

SEQ ID NO: 9221 - DNA, 2290 bp, Homo sapiens
ggggaaattgatggacatagctggatttctcacaagcccaactctaacttcttgcttatatctgcccccgacctttttttttttttttttgcattctccttccttctctcagtaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttggcggctgttgcctctttctttgggtggcttcctttaatgaaaaggctttattt

SEQ ID NO: 9222 - DNA, 1142 bp, Homo sapiens
taaaaaaaaaaaaaaaaagagccactctggtcataatcccaatatttccagggcaaccatagcccacagattcctcagtcctcccttttactgtcctctagggaaaagaccagtgcttctaggcctctggttcccccctcctacaaagtggttggcagggtgcccaggctgtatcctcggagagttaccggctttccatatgggctgatgacagggatttgaaagcgagctcctgtcctctgtctctccacccccagacagaccaagggctctgcttcagcactgtgcactacccacgtaggtctgtcccacagtgcactgggttggtgcagctttgtgggttggttttgccttttaaaaaggggatggctttgaaagttgcctaagcatgccataaagcttggaaggaaagcctgagaaatgccttatgtggagtagcctggtccacctctgctagctcggctgcccggtgcttgcctggcttcgcaggtctttgcatcaccgtaactgtcatgccatgaatgtgttgtgtccagtgtctgcttcgagtgcttctctcttgagatgggctcaggcaagacccccagccagcagggccatccttattctttctgtctgcttgccagcttgcccactagttctttctacagttccacagcagcatgtgagggggatgggtcatgtcattgcccttttcttccctggagcatgtgcatttctgtttgtgaagcaggtgggcttggtaagagtcattgcctgtatgtactccaaggttctttggtagaatgaagcaggcagggagaaacgtctccatagacccatggagctgagggtcaagtaagaaaggtaaccagttctgacagtttcctcttttcctctgattcagcctcaagtccctggtagatggatataagcagtggtcgtccagtgcccccaacctggtgaagggcccaaggagtagcccggccctgccagggttcaccagccttatggagatgggtaagcatagctcctcttgagagtcttggctgtctccctgctccctgggggcattcttgcccaagcttctaggaccatttaaggacccctagcactgcttcatggaggaaacattgggaatgtttttgttctagaatgttcag

SEQ ID NO: 9223 - DNA, 1103 bp, Homo sapiens
gtgtgttcatcactgtatcatgcggctcattgagactgatctcgaggggattcgttaatgtaatatctgattacattctgtgtttacaattgaacaatttctctttgctctagggaagcaaaaggcaatcatttctttgtgagagtggtttgatggcacgtatcgtaacatatttagtatgctataattgtaattaatgccagtttctaatgttggatttgatgtagacagtttggaataagagagttatacatattttcaagtagtgatgtggttataaaatagttccaagtatcagacttgtaaatgaagaatgatcgttgtttaccttttttgctatttgctggattaaaaatcagaacctcttagttttgtggaaaaaagtataacttaaaaaattaacaaaggaaaagcattggagtcagaataatgacagttactctttttctcatttttttctccacagtgatcctggtggagggattgaaatgtctgagttcatccgagaggccacacccccagttggttgcagttccagaaattcttatgccggtctagatccaagcaaccaggtaggaacctgcgctgttttattttgcctttttccctcctcctgatggtggtctccgttattctcgtgtctttaagtcggctgatgttttgtcatatctttctgattattatttttaattgcttattaataacatcttttattaatattctttttaagttacttttcacattgattaattacagatttgttgagcattaccacagactcatctttgggtgtatagttttgattatgacagttgtgaatagccttaggaaatttagcttctagcttgcgctatcttcacatcatgtgtattagagaggtgtagatgtctgtggttacccccagtttaaacgtggccaaaaaataaaaataaatgctgaaaatctctcagtgttcaagatgtttaatggtaaggctaaaagtaaaatacaaatttgcttttatcaattttaatgtctttctactatgtaacttttaaaatggtaactcttgaagttttatttcaaaacttggctggacctttgctgctctagtcctcttattc

SEQ ID NO: 9224 - DNA, 1198 bp, Homo sapiens
ccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggaggtaagtaaactgtaagaagagatttctgtaagactcactgctttttcatactattaattagagtagtacttactaaaatatgcttctgttaatattcccccttccactgtgttattaaaataagctttcttgaatgaagaagtaggtgattatcttagaaaaggttttggtatgaacaccaagaacatattttttggttgcaatacttgaatacgtcaatttgttcttgatggtgtcaagaacaccagtttctaagccagttgccacctgttaatgttttgctgggaataacaaaaattagccctcttcctttgtatagcaatagcaacaataaaatatataattatttaagggcaccaaaccagttttaatcaactcttatacagtatatgacactgaact

SEQ ID NO: 9225 - DNA, 1214 bp, Homo sapiens
tatagaattgtcttagcaactttgatagaagcagaggtgtttgtcactacctttagtttcaagatatgtaagagcccatatttaagtaattctagtaagtgagttttctaattctttcagatgactgagagatgggggaagcgaaatcaattagtgccagaattttgttactattttgccatataacaaatgttttaaatttaattttctagaaactattttgagattttgttttttaaacataatgtgattctttgtatacatattttatttgccatccaagttggttaactattttgcaacaaatagaatagaaaagcaaatattaaggagagtaacatttttaaaatagaaatttaaaactatattatgtaattgaaactccacaattcactgtagcatgttttatttgtatataagaattcatgttatgtccacatgaaactagtttgttttcagtatgatctaaaaccttgttcaaactcagtaccaaaaagacatcttggcataccatgaacttcatatttatgtcttcccttcccttttttccatttggttaatttcttatacttaagatatacttacccataagtttttctgtccgtagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaaggtaccagcatctcttcttttcatgctacggaattatatttgtgttaaaaggcagaggattttgtagcaattactgaattatagtaagataattatttttaggcttacttttcttgcatgtttacataagattgtgtagagagcaaaagggggatataaaccttaaaaataattgtatgtaaattagcacttcctaaaaacaagttttttgtattaaaagaaaactgtgtttgttttgtttgttttattttgttttttggagatggagtattgctctgttgcccaggctgcagtgcaatgatgctatctggctcactgcaaccgtcgcctcccaggttcaagtgattctcctgcctcagcctcctgagtagctgggattacaggcgcatgccaccatggctggctaattttcgtatttttagtagagacggggtttcaccatgttggtcaggct

SEQ ID NO: 9226 - DNA, 1203 bp, Homo sapiens
accacgtgtggttggctttggaagatagcctttgtagtatttccttctgggtatatgcagtcattcattcaaaaaacagttactgaatgcctgctcagtgctgtggaggacatagtagtttattacatgggcaaaggcatcaagaaagtaacacaccaaatgtcagacttttcttttgcctaatatatcatgtgttgtcttttcctactcttattattgtatctaaaatttactatgccaagatatcttattcttccaaaaggaacacagtttaccacaaacaatagcacttaaaatgtgaaagaattgatagcctcatgcatcaaaagcaaattattcctcatgtatgagtagagctttagtgccctccccccaaaaacatctgtagctttagtaccaaagacatttagtggccagattctaactcatcagaaagtaataaatctaaatttttctggaataaaatgcaattaataacgtggctaaaaacttttgttgaatttaagttcgttgtctttttccaaaatacgtacataaaaggattatgtgatatattacaaattagaagcatattattctgttaaattcatttttccgcaggattcttgggatggccagcatattccagtacttttctccattttttgtggtttattagtggcagtgtcttaccatctcagccgacaaagcagtgatccatctgtacttttgtaagtgaactcaattgttattgaattaaaagaaatttaagtaagttggtgtttttttcaaatacctttgaagatctctttttcccaatgcctttccaaagtgctttggcctaatctatattaagtttcaaaatataataattttgggttattcaaatcaggttggctgagaatattagtgttttccttcccaattattgaaactatgttttaataaaaatattttcactgtatgcttatttatggtatcctaaacattttagaatttctcatttggtaatgattaaatatactcgaatcatttggttttctatcataaacttcattgcccgtttgaattactggttttcagattatctatgtattttctgtttttttttcttcacataaagctctttagtgcaatccaagatttttccaaaaacggaagagaaaaatccagaagaccctctatctgaagtaaaagatccactgcctgaaaaacttagaaatt

SEQ ID NO: 9227 - DNA, 1197 bp, Homo sapiens
cattttaaaataaggttaatttttaatattatgtggctattttgatgcactatgtaacttacaccatatagatggtcagttgcctccatagtcatccgatgagcctgcccaatagagtaggtacctattgttgagtcaagcattaatatgtttttcatttgctaaatgcagttggtgttaaagtaatagaaatattgagaaactagagaatcagatgtcagaattacaatactattatttttaaaacatagtccttcatataaaggataagaatcataatgaatagtattaaaagggaatagtcagatactttcaggatgtgatttacctagctctatacatcatttttggaagcttacatttaatgtatatattataagcttagtaaagtaaatggtgaattttattttaagttactgtctcttctaatgttttcagtcatgagttgatttgtgttttctttgtgccacagattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaaggtaatttatcactgaaaggaatatccttatctataaaaactatctccctgggttatatgctagtcagaatttttcttatatttcatgtgatttattattgtttaagtaataactctcttcaaccagttatttaggagcacattagaatccctaaacaaagatagtcactgtgatttataaaagatatatttcttgctatagctaagaagataaagttacataaaacaattagagaaacattaataagtatattttaaaatatatagaatctctcaaaaggtatatagttttgaataattttagaaacagaagtggtaataattgaattgggctctggcatagcccaatgaagcaggtagaggctgaggagactgaggctaggtgggagcagtcagaaattagcttgatgtgatatttgcagaatactctgaactttataggcttctgctaaaattcattatccacccataagatagatgttctaggccttttacaaataagatggtaaaaccttggtcctctgcctcctaacccaagaatctttttg

SEQ ID NO: 9228 - DNA, 1178 bp, Homo sapiens
ctgttgctatatacagtttatctctgcttaacattagccatctcaatatggctaatattgactaaccagcttctttttgattgtcttatttgttcaaatcttgtattattttatctacttcctttactaaatagtcttttgttcttcttctgaattcttttattttcctcatttctcttccatggttttaattataaagcatattttattgaataattacgaactgttgaagaggtcaaaaagtccttagattgcttcaaatcaaattctcacattttgtgaatgagaaccatagattccgggaggttatgtgacttctaaatctaaattcagaaaccttttccattttcctgttttacttttgtatagaaactgtaagggtatgaatgttattttccttgtcaaataaatataaccccatactagaagtttttaatatttttaacaatcttgtttgtcaagaggacttaaggttaaatttaactttttttaaaatctctttttataggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtaagacattcattcaccttttatttctgtagcatactcctgtggcaccttagttttacatgtttctatctcaaaccagaagttgtcatagaattagatatttgggattgtggaatgagaaaagttgttaaagagtaagtattagattttttcaccccacattccatattccaagaagaatcatgtttgcaatatggctttatatgtaaaggtagtagcattagtgtgtaattgatttgttttcctagatatgttgaatttctgttgttctgtgcttggtctcttgctggtcccttttgtgaccagttgcataaatttgttaggtggctagcagcatggaatgctgaatttttgtgtgaggcagaatagttaactgagttatgttcatataaacaccatgcctttgtcttccaacaattttttttaattgaggtgaaattcacataaaataaaa

SEQ ID NO: 9229 - DNA, 1170 bp, Homo sapiens
ggagttcaagaccaacctggccaaaatggtgaaaacccatctctactaaaaatacaaaaatttatctgggtgtggtggcgggcacctgtagtcccagctgaggcatgagagttgcttgaacccaggagatagaggttgcagtgagccgagattatgccatcgcactctagcatgggcgacagagtaagactctgtctctaaataaataaataataaaataaaataaatagaattgttttgaagttgctttgttgaatttatggttgtgattttaaagtattagatgttttttcatccagtaaggcctgaggtatattattatagtattcttaaaatatatatgtagaatattgagggggaataaaatactttttagtcagactaaaaagtgttttactatttatcattataaataattggaatttatttcattgagtaatctgagttaattgaaattgtaatttaatctgaattcttttttttttgtcttgttcatgttagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaaggtagagtttatttcatttataactctttgaatccaggtttttccaaagatgcaaagaatgtccctgttagttcttatgaggtcagtttttcaagaccttcctctttctgatcttctggttaagataacctaactggttcattatggttgggccaaaccagctctgccaaaacaggttaaaggaagtggcctccctctttctttcatttgcagtgtcccagtctcactgtccaggtagcacctccttcatcctgggcatgtacaggcatgcacatacattcacattccatgcattaccctccaaaatctagtccttaagaaattctacctctgtctgccacacttaaggataattaaatgtctttgtcccaaatagaaagtctagaccagtgctggctaatggactttctgcagtgttggaaatatgctgtcactgcca

SEQ ID NO: 9230 - DNA, 1164 bp, Homo sapiens
tacaaccaccccatgaattttgattggcctcctcctgtttacatctatttttctaataaattcattttccatatttccttgcagtctttgtccagggtatttatacttctaatatagtaatatattagattcggggattctaaatctaaactgaatttcctaacatatacatccaaatgaatcagaattaagaaataccacatattttaaatttttttctgtgataactacatgttttccgttaagcttttcttagtttattttaacttataggctctttgcctgttgtttattttcatggactcactattacagtggtttataaataagggtcccaggtcggacaggccctgtctcttgtgattctggttcagggttctgacattagttcctggaatctgtattttcaaaacactcccaggtgattctgatgcacacgcagatgtaagaatcagtgtcatggaagacctttgtcaaaacatgtgaacttttatctccaatcttaacagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggtaagaagatgagatttttctaattcattactggtgtttactgatccttcttcacatgatttcaatattagtccattctcacgctgctgtaaggaatacccgagactgggtaatttataaaggaaagaggtttaattgactcacagttccacaggggtggggaggcctcaggaaacttacagtcatggcggaaggggaggcaaacacatccttcttcatatggtggcaacaaggagaagtgccaagcaaaagggggagaaccccttataaagccatcagatctcatgagaactcactcgctatcatgagaacagcagcatgggggtaactgctctcatgattcaattacctcccaccagttcccttccaggacacgtggggattatgggaactataattcaagatgagatttgggtgaggacacaaccacaccatatgagcttccaagttatgtttcttaggaaccttttgagaaatattctgatctgaataaaagaaaaatgt

SEQ ID NO: 9231 - DNA, 1466 bp, Homo sapiens
ttccattataggaatttaaaaagtaattcctctctgtgaaaagcattttgtttgagattacataatttttcatcatcaagaaaaaaatgaattggaaatgtttttatttaccatgtagattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtaagttcttttacaagctggcggtctggggctctgccttttttgaagtccgcctcacttggatgcatggttttagctgatttatacttaaacgtataattttcagacaaaattgctactactaatcctaggtaggggtaagagtttgtgagtatattccaggtctccagtgctaacttcttgttttattctgaatcattaggtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctaca

SEQ ID NO: 9232 - DNA, 2026 bp, Homo sapiens
agtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatgggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttgccttctgtccattttttgtcaaactgagaaaaattagagtacactatattaagttctgtatggcatgttcacacttggttctgaaatcattttaaacaagctttggcctgtaaacatgtgcttcaacttgcaatagatcaaaagcgtacatcatacttcatgttaaaacatggtctgtttcacacttttcttagtgcaagggttgtagtttgtcttctgaatttatctcgatgttaca

SEQ ID NO: 9233 - DNA, 1589 bp, Homo sapiens
acaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaagggtaagtagagatcctttatttcttacattttcttttgcagtactttctgaagaaaagtactgtatattaagatatttattaacaatgtgacataagatttgcatgtcttatctttcttgatggtaaaatagctaaataaccatttgctcaatttatttctttttgcattttttgagttactttctcctttcagatatataaatgtcttgtatgttaaatagtacttttacaaataaaaagcccctttgacttagcgattgaaattatagtctttgttgtacagtagatttgctgtgtcacctttagggataaatataccaagttgaaaatatttgaaatatagctgttgtttaaggattgcaaaacagttttaatgctactttcattttttatcacttccacagtaagtacaggaatcatttctttgctgcttcaatgttgtcatcagtaggtggtaattataatatattcctgtccatttacaggaagtattgtgaaaacaaattacattatttga

SEQ ID NO: 9234 - DNA, 1142 bp, Homo sapiens
tcttgttgaaggagtacatcagtgtcagatgtaatttatcctctagcaccaaggtgtggcagagctgacctggctgtcactcagccgcttatcaccgggtagtttccatttggctgcctaatgcattcctgacttcactgtggctaagtctcaggtggggagggggtggagggggagtactttactaaagtatgctatacagctgatattatatgtaaaaatcatatttggctgatgaagctataatcactttattattatgttgtttttataaacattattttacaaatttagacttcagaggctattttagtccaacatagaagccaggtccattgctggaaaaatactggatcagtagaggaatcccattgtttgtatttagtaaaataagcaacatgccattgatgcttttctttccagtcctttctcatgcccacttctctttgccattttgctagtgagtgtatgtttatattgagaaccaggattaaatgacagtaataatatagctaacatgcatcatgttacttctttgtactttattgagttcctcacttaatgcccattggacattaaggtggatctgtactggtgatagaagtccaagtgatagccacatcctccttatggaggcacagactaggcagtagggctgcattcagattaacctgaattacttatcttcctttgagtatgtatgtgttttgtgttatttatttatttatttatttatttatttatttatttattgagacagagtctcactctctcacctacgctggagttcagtggcacgatctccgctcactgcaatctttgcctcctggattcaagcgattctcgtgcctcagcctcccaggtagctgggattacaggtgtgcagcactgtgccaagctaatttttgtatttttagtagagatggggtttcaccacgttggcaaggctggtctcaaactcctggccttaagtgatctgcctgccttggcctcccaaagtgcggtattacaagcgtgagccaccgtacctggccttttgttttcatttagatagtcaccatgatcagagtactaaggaaatttataagtggaaaatactaagttatagaataattataatgttgcctatatcctgcatagct

SEQ ID NO: 9235 - DNA, 1146 bp, Homo sapiens
gctctttcctctgagctcctactccaccatacacaggccacctgggagcagagtgctgcccagagactcgcagcacacatctctctctccaatccagggacatcttttttaatctggtggaatccccctttcttcaaactctgttctcaatatgtttagaatgtttttgaaaaacaaaaactaaaaagccctggcacaagccttctcttaggcaaggaagtgtgcacaaatgtagcctatttaaatggtgggagatagggagaaaatacaaatttattttgagaaatagtagagtagtaatctgtagagtagtaaaaaactcaacaggccacccgtgttcagtgttatcttctctggaactaaacctgtgtagccaagtctttgtttttataactaactgaagaatattaatatttgttaaatgtttacattttattgataaaatttctgagtgacaaccttaaatactgagcagaatgtaacattttcaaagtgttaggtagattttctaactttgttttgtcttattttacctaagaacactggaactattttggggctgatgagaatcttggtccagtggctgtgagcattcgaagggaaaaaccagatgaaatgaaagaaaatggatctccgtacaactaccgaataatttttagaactagtgaggtaagtcgcaaatgagagaggtttgaggtttaactgaaatggggaagaaagcaaatagtagcagtagcaaagcaattaaatttaatagcacatggttacagctgtctttggagtaagcaaagtcccctttcatttattctggtggagatcgaggtggacaagatggttagatctggacctcttcttttcatcagactctgaatagatgcagtctatgaatgaggagttttgattcagagaaagatatgtccattaagtgtggcccaaggaaattggagccctcagatccccactgggatattgtgtatcctgcttagggctactggaaagcgccaagccaacttgaggagccaggatattagatataagagaaggccactgaagacttaattcactcttccaagctcttgctgagctcatgtcttcgcccaagaagaaggagggaaagagattcttgacttcttccactatctttgg

SEQ ID NO: 9236 - DNA, 1145 bp, Homo sapiens
cttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatc

SEQ ID NO: 9237 - DNA, 1173 bp, Homo sapiens
ggctgagatgggaggattccttgagcctgggaggttgaggatgcattgagccatgatcacgccactgcactccagactgggcaaaagaacaagaccctgtcttaaaaaaaaaaaaaaaaaaaaaaaatatatatatatatatatatatatatatatagtttatttatttatttatttgtgtgtgtgtgtgtgtgtgtgtgtgtgtgtgtgtgtgtgtgtgtgtatatacacacacacttgcctgagatcacatagctggtaggtgatcgaggatcggagccaccttacctccaacagtatactacctccctgatatcagtactattcgtactgtaaacacgactactgggaacgttaacaaagatgcattttcggaataaccacttgtgagccaggcatcccagctgagtctctcttgcaaccacaaaacccagaatggggccaaaggtatagaccctctgagcagctatgggcatatttggatgttttccgaacccagtggtccctggcctgcctagaaggcagccacactttacattctcctatccccttagcaggaatagaccggcctggcatgctctgcagtttccggatccctggtgcctggtcctgtgcctggtccctgaatatccaagcaaataactgcttcagtacaggtgagcctggctccccaggtgcccagagaagaggccttaacaggccttaaaaccccatgtagttgtccctctccccagactacatgtgacataatcttaccagcccatctctgtctccgccaggcttgtctcggcgggtcctgttgaccaacgtggtgacgggacaccggcagtcctttgggaccaacagtgatgtcttggcccagcagtttgctctcatggttggttggattgggacaggcagaatataaaagtttgccccatgtagaaatttggccagattgaaattggactcctctgtgtgccatctagtactctttgacaggggagaaagagcatcagaaaggatcagtgggttcctttgtaagggtgtctgagccgagtgaaagttggttgatccagaaaggctggcctgagttgctctacacaacctctcatggaaaggtattgtgagcagttcttgggtacttggatttacccagtaggacaaaccatttttaaaatgtataagccaaac

SEQ ID NO: 9238 - DNA, 1191 bp, Homo sapiens
gcagtggcacaatcttggcttactgcaacctccacctcctgggctgcagcaattctcctgcctgagcctcctgagtagctgggattacagatgtgtgccaccatgcccagctaatttttgtatttttagtagagacagggtttcaccatgttggccaggctgatctcgaactcctgagatcgggcagattgcttgagcccaggagttcacaaccagcctgggctggtaaaaccccgtgtctattaaaaaaacaaacaaaaaacaaacaataagctagcagagtgtttcctgtttcaggcctgctatgagagaggcgaggaagtcagtgtagtgcccaaaacatctgcttccactgactccccctggatgggtctcgcaaaatatgcctggtctgggtgagtttaaacaacatggctcaaggttttctggtgcgtttgtctccccaggcacctggctgggtaacagtattgatttgctttccttgtaggtatgtgatcgaatgtcctaactgtggcgtggtctatcgtagtcggcagtactggtttggaaaccaagatcctgtggatacggtggtgcggacagagattgtgcatgtgtggcctggagtaagaactgttggatttctctgtttttctttatcttgtgtcgttcagtttttcatgtgtatagaaaactggaacctgcttaaaattaaggttaaccatgaatttcagaatgttggcggtttagaaaggcatgatctggagagcttttttgttctctagaccaaaattgtttttattttttcttgcatatatattagaagtacaactttaaatgaaataaactaaaaatctatagttttactcctttggcaaataaaacgtttttgcatgttctactcattcattttctatatgtgtatgtttttctagatgcaaatatttacatgcctttttcctgctttttttcctcacaatgctattttatttagttttatttccacctttttaaaaagatcattaaaatgctagtcaccatcttcgtgtaagaaagccatttttttgttataggaaattttcttgaagtatattctaagaagtgggattcctatagacgcttaatctttttttttttgagacggagtttcgctcttgttccccaggctgaagtgcaatggtgagatcttggctctcttggctcactgcaatc

SEQ ID NO: 9239 - DNA, 1232 bp, Homo sapiens
tgcctcagcctcccaagtagctgggactacaggcgcccgccaccgcgcccggctaattttttgtatttttagtagagacggggtttcactgtgttggccagaatggtctcgatctcctgacctcgtgatccacccgcctcggcctcccaaagtgctgggattacaggcatgagccaccgcgcccggccaattgactccttttaatcatgaatttcattgactctgctaaatattttattagagcttctaatgagtagcagtttgtctgatttgaatttttcttcctctctgtttttccctttttttcccctttggttgtttgaggatactaaaagtgaaatggttatcaaagggaattggtggacaggggtggaattatgaattgagtggtctttgtattaaaacatttggactctagtgattctacttttccataattttttttcttttgtaagtgaattggtatttcactaattgttttcatccattgctagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatggggtatgttttctgtcgtgttatcttttctaggccagactgtgctatttcagtgtagtgcttctcattataaatgaatctaatatggggcttcaaaagatcatcatgtatgtgcttgtggcttaatgtaggagggtattttatagtttgtagttattttaagtcttatctgcccatagtgggtggatgactgttggtttgcttgttccaggttgggatgaaagtagtaagggaggctggacaaggttaacttgccagagaaagcactggtacagactattccaaacagagctaattcattaaggcagctttgtaagtaagtacaaaatatatttcaacctacacaatttttattagtttccctctcttttagaagtacaccgactctaaaatgaatgaaagtctgattacttgccttaggttgggggctttatccaagctctactaagtgaagctaaaataaaggacattgttgtatattgtattttaatgtatacattattacctcctcagcaaagtgaaacatagctaaaacttgagtatatatttccttcatttctcttcttagttcctttttggc

SEQ ID NO: 9240 - DNA, 1206 bp, Homo sapiens
agtttggtatatttagcaatctgatgtttttgtttgtttgtttaatctacatacaattttgctttttctgagtggtagctatcacaattaacttaaaattgtattttgcctttactacgtaactgaattttcaactgtttaaaagagtcgttactatttgtgtacctattgagcaaaacagtctgaaaacttgtgaatggtttgcagatgtgtcgtatagtgtgctagtcctgaaatttagggaccagaattttttagctattaagaaaaagaaaatgaaaatgaagtagtatctcaggaatagttaaataaaaaaatgaagcttttctgatgttaagaacaaaaccaattctgtgtttaataggactacagagatgtttttgagaaaacatgtatgtttattaactcttgttgtagagtgattttgattttcttgcttgatttttctttcccctgaatttgctgttttgtttaagaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacgtatgtgttctgacaacaacatatcatttctaccgtttgttttttatgatatcactcttatactttgattacatgtcagttttcttttttcttttcttttttttttttttttttttttgagatggaggctcactttgtctcccaggctggaatgcagtggtgcaatctcagttcactgtaacctccgcctccggggttcgagcgattctactgcctcagcctcctgagtagctgggactacaggcatccgccaccatgcccggctaattttttggtttttagtagagacggggtttcaccgtgttagccaggatggtctcaatctcgtgacctcgtggtcgacccgcctcggcctcccacagtgctgggattacaggcgtgagccaccgtgcccggccacattttaaacttttttacagagacaaggtctcactatgttttctaggctggtctccaactcctgggttcaggttatcctcctgcctccgcttcctaaagtgccaggattacagtcatgagccactgcgcccggcccctattttac

SEQ ID NO: 9241 - DNA, 1152 bp, Homo sapiens
attagtatgagctctgtttttcttttttaaaaaagattcttggtggattttttcacagattttccgcagatttccagtggccccactgatcccttatccactcatcactaaggttagtttaaattgtaggctttgacaatacctgtgtttactgctgattgttgatttgtcattcttgtctatctgatttttcactatttaactttagattgttagatttgttattgtggatattctgtttacttatttactctttgagacctatacagaatatctaacctttaactgtttatattgaagtagggtgttctttattcattccctcctgtgcccgttttcttttaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcac

SEQ ID NO: 9242 - DNA, 1159 bp, Homo sapiens
ttaatccatgcaacatgtcagaattctgttttccacatgtgccagcacttactccttgatctctagtaagctaaactatctcttaacatattcattagtccttcatatttcttttgggaattaagttttccttttttctgttttacaccatcaggggattgactattatttcagtatatgatgggcattaactaaccattcattttaatgatttataactattttatattcagattgtatttgttttctgacataccagtaagcattaggtattagaatgcattttaggatttgggactgcaatttatgtctttctgatgagtgtagaggaggttacatagttttatggaaatcaagtgctagattctggcctgtgagattttatattatttcataatgtatgttgtcctcctttactttggtcttgaaaacagaaagtagactgacagatttgtaaaatattttgtttacattagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagaggtaagttgagaaaatgcctttattcttaaatcttggtatcccttaataggttaatcaatatttatagaatgctatgtataaatttttaaagctttgaaaatttaatttttttagcgccttaagaattgggaaatcagagaacgaaagaaaacccgggaatatgagaaagaagctgaaagagaagaagaaagaagaagagaaatggtaagattctaggctaaaataagtgatttttcaggtaaaaagtcagattgtatctttactgctaactacaagtaacttaataattgaaatgcacaagcttctctattcatgtataatttaatttttatgtattttgagtaattttgagccaatttaagtacaccaaaatcttttttcctcttcaaatttttgctgcatctaaagttatctttttgtataccatcaaagtaaatttgtcatatagtaatatttaagt

SEQ ID NO: 9243 - DNA, 1148 bp, Homo sapiens
ggcaatgtataacgtcaacattctgagaagtaatgaactgctagataggagagaacctctgctttctgttgattctacactactttctgagataatttttacaagtgaataaattgaggatacagaactctcagtgctactaatgctacttgatatatttttttaggttggtatctaggaaaacgaaaattatttgttgggtattccttgtgaaataggcacaaagtgtgagctctctttctgaaagtgactattttacttgtttagacacttattagaatgactttaagaatgaagggaacatagtgataaatgacaagataatgcttgttatacatttacatgtagagagcacactctggtgtgttccgtagatacagaacattaagacattctttaacctcttagcatgcaggttgtaatgttgaaaagaggtgctgttggagatgtcatgtttacttctcaatgatcggagtattaaatgaagccttttatcattcacttttacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagagggtaagatactgtaccatctggtcgggcgcggtggctcacgcctgtaatcccagctctttgggaggccgaggcgggcggatcacgaggtcgggagatcgagatcatcctggctaacacggtgaaaccccgtctctattaaaaatacaaaagattagccgggtgtagtggtgggcgcctgtagtcccagctactcgggaggccgaggcaggagaatggcgtgaacccgggaggcggagcttgcagtgagccgagatcgcgccactgcactccagcctgggcgacagagcccctgactcctgggttcaagcgattctcctgcctcaggtacccgagtagtagtacggattacaggtgtgtgccacctcgcctggctaatttttgtatttttatttttatttatttatttttttgagatggggtctcgctgtgtcgcccaggctggagtgcagtggtgtcatcttggctcactgcagcctccacttcccag

SEQ ID NO: 9244 - DNA, 1157 bp, Homo sapiens
gtgatccgctcgcttcggcctcccaaaatgctgggattacaggcgtgagccaccacacccggccactaaaacaaccttaaaatcttaactagcatttaagtaataagtgcttattgtcagtggatgaaaaacttttttatactggccactgtttttggcagatgttgatgattgcttctcttacatgtgttgctgttttgtttcctctttaggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgt

SEQ ID NO: 9245 - DNA, 1191 bp, Homo sapiens
ctgacttcctatctcatcccgtaactaagagtacctaacctcctgcaaatgcagcccagtaggtcttggccttattttacccagcccctattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaaga

SEQ ID NO: 9246 - DNA, 1854 bp, Homo sapiens
aaatgctttcataattatgtgtgaatgtgtgtctttcccatcttctccacagggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgccacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaac

SEQ ID NO: 9247 - DNA, 1156 bp, Homo sapiens
aaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttgcccatgaagggctgttctttcccctttcctttattagtaaatgaatttatttttcgttcttttggtcttactctccattctactgctgctgtaaatccctagtttagtgactagaaaaatacccttaagattcatattttcattcatactttaatcctgagtgtatctctaaagtcagattcttgctgctcaaagtgtggtctgtaacagcagcatggacttcacctaggagctggttagaaatgcagaatctcagcggggtggggcagtgcttctcaacctgggctatgcaatagaatcacctgaggatatctttttaaaatcctaacgcctggcctatattccagaccaattaaatcaaaatt

SEQ ID NO: 9248 - DNA, 1170 bp, Homo sapiens
tcagttagtggttaaaatgactgtcatgatcatttctttgactgataatgtggcaatgttactcatgtggacctcgccttaagcacacattttggttttatagttccttatgtgtttaaagcattagttatatttgaattcctagactaaatgctggccattgatgtatgtcaaaatttaccctaattatttggtctggtgaccctcattgttgggaaaagtgactaccatggttataagtaagggtataatgaaacttagtatttcaaaatatattttttgagaagttctaagttaaacagctcttaaaatgtattatgtacgtggttgtggagggaagggagatgtttcattatgagatcccaggcaaatggcaatatgtttgaggattgtctcctacataaagcagtgtaggtgatttaacctcaaaattgcaaagcaatagttagatgcagaggttagaatttatcatgtaaacaaaaaatccttcaggaaaatgtaagacattgtagtcagtaagcagatgaggtcataggaggccatggctggatcactattagattgcagaaaagaagtcaggggccctctgccaaattgtgcctaaagtccctcagagactgttgattctggtttccccatctacttgtgtgattttacttgcataaaatcacagtgaaagagggaagaatcatctttaaaaagtgattgcataagtagtcctgggtttcagaagatttcagctatcatttacataggaattacttgatttttctaagttactctgatcaaaagggaccactgctttgacaatcaactctaaatacaaacaagaggccaggcgtggtggctcatgcctgtcatcccagcactttgggaggccgaggcgggcggatcatctgagatcaggagttcaagaccagcctgaccaacatggtgaaaccccgtctctactaaaaatacaaaaattagccagtcctggtggtgggcgcctgtagtcccaactactcgggaggctgaggcaggagaatcatttgaacccgggaggcggaggttgcagtgagccgagattgcgccattgcactccagcctgggcaatagagcgagactccatatttaaaaaaaaaaaaaaaaaaaaaagaggaaaacttggtctaacacccttttagtttt

SEQ ID NO: 9249 - DNA, 1470 bp, Homo sapiens
tcattctccttggtgatgttttaagttccataaactgagagggaagatgatcttcttaaagtttgcacttccttcagtaggcaagcttgaagccatgttgatatggatatgttttctaaaagtaaccctggaagtgaatataataggaagtaagtgatttcatattgaatttatttgtaaaatggcttagagttttggtgtttgttttttctgaattctgtaatatagaaactggttctctttctccttgtttctcaatgacttttaattacaggtagttctcagacaaatgtaagatacttttctctgtccatttcatgcaaaattcatattcagtatcattcaacaaatctttgaatgacttctatgcatccctgttcatggaacccatgccattagaaaatggcagttgggatgtatgaagaaatgtaggatattctctcaaatcattccctaaattatcctttactgctgcaaatttagctgataaaactgcctttggtttatgcctcttggatcagatatttgacctatgtggaatagattatctctgtgcttccggtttaagacattacgccattttagtggatcatttaaattttttctattctgtttttttttgtttgtttgtttgtttgttttaaacagagtctcactcccgagtagctgggaccacaggcacgtgccatcatgcctggcctatttttgtatttttagtagagatggggtttcaccatgttggccaggcttgtcttgaactcctaacttcagatgacctgcccacatcggcctcccaaagtgctgggattacaggcatgagccaccgtgcctggccaaatttcttctattcttgtaagtgatggtaaaactctggaatcagtccagtattttagtttttcacagcaaatttgattttagtctaccaaggagtttaacttttctatgttccctaactctaagattagggctgtattacctagacaggccttaaaaggtttttgtgttgttctctgttaataagaatttgttcctttaaaccagaggatcaaccttggaactattaacattttgggattgataattcattgttgttgggggctgtcctgtgtgcttaggatgttcagctgcagccctggcctctacccactagattccagtagaccccctcctcagccatgacaacaaagatatctccagacattgccatctgtcccttgggtaggagggtgggaacaaattctcccttagttgtactttttataccaacatcacttgtgtccagggtccatttattttcagtctgtagccatgtgccacttgaattgttatatgagagaaggtgatgtattcagtaatcatggatggaaagaaatggtcactggtattttttgtaatgctcatttttttttttttttgagacagagtctcgctctgttacctaggctggagtgcagtggcgcaatctcagct

SEQ ID NO: 9250 - DNA, 1169 bp, Homo sapiens
ttctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggtgagagtggcatgcagtggagccacacctggcagagggcatcaggctgataggtgggcggctgcaggatttgcttcttgcctagggaaagccagactttgccctagccagctgcctgtgggaaaacagtacaaagaccacccttcaccttgccacagggttcttgcttactttcttttgcagaaatattttttgaataattagatactatttcagatacagatagatacagatcaccgggttcaagtgattctccagcctcagcctccccgagtagctgggattacaggcgcctgccaccatgcctggctaattt

SEQ ID NO: 9251 - DNA, 1171 bp, Homo sapiens
gcttttgctgcctctttctcagctgggctggaggggcttgggctggatgtcagctccacctgtgccttagaatgtgcctatgcagtgcacaaataacacagacagatgcaggcagtcctggagcggaaccaggagggtgaggtggtgggacaagagagtcacagtgccctgggagatgcagctgattctcctgccctcctggcagctccccaaaagtcctggctcctgcctcaccaatgctgctctgtgacttggggcctgtccctgtgatatgaggtggtgggaccgaaggcccttggagccccttttcttacacttgtgctgatgttcggggcatcctgggaggctgtggctgacactgtcactgctcttccctctgcaggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtatatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgacc

SEQ ID NO: 9252 - DNA, 1108 bp, Homo sapiens
acagggagactccttggtgttgtgcagagtccccaggtgggtggcagctggagagcccccggcgtaccttgagttcgcaggttggagcctgctgaagctctgcccgacagaatgcgtgtggagggaggcccagacccagctggggccctggttatctccagtgtatatttgctaaaaccaaatttcagaactgtcaaagactggagtttgttcttctgtgatcagattgaagtaggaccttgtggctggaggtgtgccagggtcagagagaaaatggagagtatgggctcagggcacgcctggatgctcattaggggtactcaggccagcttcatgtgttccatggcaagtgatggctgtgtgtgtgtgtgtttggaggtggggctggtgactgtctctgtgcttttctagaatatcgtgtttattcctagatgccccaacctcatcttcacgccctacagtggcattgagcctggttctgatcattgctggtcatgtgaatattaagtgccatagtgtctaaggaacaagctgccttctcgagcccaggccccagcaataactgttcctctcagttccctaatttagagaccacgtgtgtgccccagggttgtcagcagctcggttttttgaagcttgaaacacatttccatagaaacaatgctataaatggtggttgggtacctaggctagcccacaaagagccctggtgtcacctcagaagttgctgaaataaggtattagtgaaattgagagcccaaatgcagcagtcatagttagtacccaggacgctggaggttaattggtgtgggtttatttgtgtaatttcctttctttggtgagaggtgtttcaaagctctctagataagggatgctctgtaggcactcccccgcaccatccccacccagtcacaatccctcctctcccggtttacattccttcttctttcctcatcaagccaggggcctgggcctacctgccctctggtatgtttatgatgaggaaatcctgttcagtggcccttacatcatcattgtcatcatcaccatcatcatcatcatcatcatcgtcatcatcatcatcaccgtcgttactgttatataaatc

SEQ ID NO: 9253 - DNA, 1196 bp, Homo sapiens
aggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgcctttgtgagtatcaatttacccagctgatgatgtgctgcagggggagatacagaaaggtgttgtttttttttttttgaaacggatccttgccaggctggagcgcagtggcgcgatcttggctcactgtgcaatctccgcctcccgggttcaagcgattctcctgcctcagcctcctaagtagctgggactacagg

SEQ ID NO: 9254 - DNA, 1123 bp, Homo sapiens
ataatttaagcctaggagtttgaggctgcagtgggctatgatcacatcattgttactcagactgggtgacagagttaagaccagtctcttgaaaaaaaaaaatgaatagggatttctaatgatgaagatgtttaagctccttttgctgcttgactagtttcatccctgagaacttccatttaaagatatgttttttctgatgggtgcagtggctcacacctgtaatcccagcactttataggaggctggggagggaggattgcttgagcctaggagtttgaggctgcagtgagctatgatcacaccactgcactccagcccagtcaacagagtgagaccctgtctctaaaacgtgtgtatatgtatgtatatttttctttttttagctgaaataaaacaaggacacttgggaagaatacctacgtgattattatctacaataattattttcttcaccttactgtgttaagagtttcattcacttttattttttctccaggaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataa

SEQ ID NO: 9255 - DNA, 1192 bp, Homo sapiens
tcgtcattcccatctcctgaaacaggattccttaagtctagatctggagtctccccatgctctagagaccctagccatgtgccagaatctgacaggagctggtagcagagtacctcagcccttaggtgtgaacttcaccacagcaggttcatgtcagctcatctaaggaatggagtgggaaggctcctcctagtttccagtgtatgtccaggtagagtttatcaggtttaaaaagttacaggatcctgatttgagctggcagggttaaatatatgcctttccataggtccagttcacctatacatttagatggtttggtttagctttacttaaagtcaaaggaatctctgtgtttgtgtttttgcaagaaactggtaatggcttgcctagtttcttctctagtttcttagggcaaaggaatgagttttgccaaaattttatctaggaaaaatggagtagttttctaagtcttacaggacactgtcaaaatatggaaatctattttattgccttagggaattctttttttttttttttcctttttctctaggtaaaggagatcttcaggaagtcacctttcctggtaccaaagggcagtgttagcatcatggatggatccgacgaaggtgggagaggtgttgatatgcgttccagggggagaggggcaggatcagtgaaagatctaactaaaggaactggggccaggaataaacagaaggaatgagatagcaggaaatagaagacagggagaagggaacatgtgctctagacatggaatttagagaggaaaaaaaaaaaacaaggttggggccaggaaagagaaaaaatgctctgggatctaatccttgtctttctttctttttaggcatattagcttgggttactgtgaattttctgacaggtaatacatcctcaagtttatctttagagcttaactagcttttacatgcatagtcagaggagtaaaagccttttctttcattctgtattgtttcttcttctttaaaaaaggaaaagaggctgggtgtggcagttcatgcctgttaattccagcgctttgggaggctgagttgggcagatcacttgaggccaggagttcaagaccagcctggccaacatggcgaaactccgtctctaccaaaaatacaaaaatagctgggcatggtggtgtgtacctgtagtcccagctact

SEQ ID NO: 9256 - DNA, 1319 bp, Homo sapiens
actgcctagaaattcttttcctatatatccacttgatgaattcctgcaactccttcaaatacttgtttaaaaatcactttcttattgagatctacttaatactataacctctcaccttcacatgctcccacctctacctgctttctcaactccccttactctgatccacttttcttttttccacaccacttatcacattctaacatactggaaagcttactgatatttattgtctgtgttcctctgatagaatataagctcctcaagagcagaaatctttttgtttactggtgtaacccaagaacctagaagagcgtccaaggtggaattcaataaaaactgacaatagaaatgggctagggtttctctcagccttagcgccattttcttggaaacctctgcatcatgagagctaagtggaggaaaaagcgaatgtgcagtctgaagcacaaaagaagaaagatgaggcagaggtccaagtaaaccgctagcttgttgcaccgtggaggccacacaggagcagaaacatggaatgccagatgctggggatgctggtacaagttgtgggactgcatgctattgtgtagagcttgtctcaatggatccagaacttcaccgccctctgatcgctgatcacctctgagacccaccttgctcataaccaaaactgcccatgttggtcctctgccctggacctgggacattctggactatttctgtgtttacttgtggccgagtataacaaccatacgataaatcatctcttctgctgtcttagctgaagaatcaaaaaaaaagaaaaagaaaaaaagaaaaaaaaaattggctgggcatggtgcctcatgcctgtaaatcccaacacttgggaggctaaggcaggaggatcactggagcccaggagtttgagaccagcctgggcaacacagcaaaaccctattaaaaaaaatttttttttaatgaaaaaattagccaggcatggcagtgcacacttgcagtcccagctacttgggaggctgaggcagaaggatcacttaagcccaggagttcgaagctgcagtgagctagaatcatgccactgcactccagcatgggtgacagagcaagaccctgtctcaaaaaataaattaattaagtaaataaatacatgtattaagcaataaaaatatttattatctcatcccttttttatttttttgagacagagtctccctctattgcccaggttgcagtgcagtggcgtgatcttggctcactgcaacctctgcctcctgggttcaagtgattctcctgtcacagcctccgaagtagctgggactaca

SEQ ID NO: 9257 - DNA, 1183 bp, Homo sapiens
ccaaatattgaagagatgtcatactactaaattgcaaaatgcaaactagttttgtttcagactttttatacagtgcttttcttgtccttgatgttagtcatttgaattgatgcccaatctttaatttaataattggaggctattattaataacaataactgatttacttcttgtccaagcctttattagattcatgggatgtaggtatacagagatttctggggctgttctgggctattggagatcttgtagacctaaactattcaaagcagtagccactaactgcatgtgtttgtttgaagttaaattaattaaaaataaaatttaaaatctaattcctcagtcactctaggaaatgctcagtagccatgtgtcgctaatgactaccacattggacagcactgctctagaccaaaggtcagcaaactatggcctgcaacctgtttttgtattctctgagctaagaatgttttttacgtttttatgggggctgtaaaagtaaaacaaaaacaaaaaacggaagaatctgaaacagactgaatgtggcccacaagcctaacataacatccttacgtcccattcatacttatgttatgttaggcttgtgggccacattcagtctgtttggttctttacaaaaaacctttgctcagccctggacctatgcttcctcttggtgacgttttggctttctgatcaaattgggttaggactttccataagtcatcagaagactaaatctaataagcaaatagacaaatttcagataaagtttcttactatagatagactatggaatgagtccagagcatacacaaatcagttccctgaagctaggacaagcgggatgtgcatttgaaataggaaaatagtttatagtataaattatcaatttcctacaagctttgtgcataacacctatagtttaacagaacatctttcttattttgtacactattttgtgtcttctgtgttctatactctcctatcttactctgacagaaacagaatgagcctgggcatagtggcttatgcctgtaatctcagcactttgagaggccaaggtgggaggatcacttgaccccagagttcgagaccagcgtggacgacatagaaagaccctgtctctgccaaaaaataccaataaaattagccaagtgtggcagtgtgcccctgtggtccc

SEQ ID NO: 9258 - DNA, 1618 bp, Homo sapiens
cccaccaggcccacctccaacattggaggtcacatgtcaacatgaaatttcaaagggacaaataaccaaaccgtatcacttcatttatatgccattgatctaagagagaagagaatgctttagaaattacatttgataaattaaccaagttagtatgtggtgctgctagcatcaaatcacaagtataactttgttcactctcttaaggctgtaagctgtgcccacatgctaagcagccctcatgatttaagaaaaaaagtatgaggagttaggaagtttgctactgtacatctaggattcatagttaaaccaattatggatagaagtcaggtcctattttcatttttctcaattatttttctctttctccagataaaactggtggtggagtggcaacttcaggatgacaaaaaccaaagtctcttctgctgggaaatcccagtacagatcgtaagtctatctgggggtgagagggcatgggtggagggaagaaagtggaggagaaatcagactgaaactaaatcagtgccataagataaaaggaatttcaagactgctgttttatgcctctcaacctctaaaagcatctgagaccctatttcctgagagctcagaactgttgcctttgtaatatcctttgttaaaaaaaaaaaaggttgaaggaaagaagagagagtgagactgtagagattgatttaactgtcttcattggtttttttctgtcggagtaaggaaggtccagccagacaggacctgaaggaggttgcttaggaatgtctgataacttgccctagggttattgccctgacagtggaggaaaggttccaaaccacttccactgagctgggacattacatccacaggtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgcatgtgggctgtggtcttctcctgctcctttcagggtacattctgctagaaccatggaaggcaggcccccagttccgtggtcccagagtgcactgaagacatgactttttcagaaactctttttcctcctttttgtccagtaagaccatatctattttatataaaatggccttgttttgctttatttgacacaatcttataccaccaagcatgctcgaaagaagcagtgaaagtaaaaatcacctagttgaataataacgcctgaaaggttgaaggaactgaatttggtggggagggcaggtaggggttagggattacaggttaggatgaggcatggtgatcttttgggaacactgctgtgaagaaagcctagaagcttaaaaatgaaatgtgaagttgtagcaagta

SEQ ID NO: 9259 - DNA, 1618 bp, Homo sapiens; identical to SEQ ID NO: 9258

SEQ ID NO: 9260 - DNA, 1259 bp, Homo sapiens
cgcccgtctcacagtgaggatgcagtaaaggtttgttgttctgaatcaaagtaactaagttataggagcaaaattgatctgcccaggtccattgggtagtcggtagaaagtcaggccggactagattccaggcttaagtccctacacgtttcccagtatttattccattgaatcattttgcctcaaagaaaatcagcacctgttaaaggtaatggggaagctccctctgtactttagaaaacagaggatgtgcacctctgggctcagggggtgtcttttttgtgtttgcgatactccttaatgccttcctcctgtcttttcagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaagaaggttcttattgtgttgtggatcagggtcacagattgggtagcttggacaccagttattagaggatgagaaaagtaaatgaaatgttctctttttcacttcaccctgccagaatgtgccacttgacttatctttattgtctatgcaacccatttgccacttcctgtttgataggacagatacattttactctcatgctcgtggatctgctatgagtcataaaaccaagagcccgttacccagaaaacttggaccaaaccctcactgatagtgaattatttcaaaaatagcctccctactcatacagacattttaagattctgtgacaatttaatgactgaatctttttaggatatgttgctttacctgccttctgttgtaaaatggctctggtctc

SEQ ID NO: 9261 - DNA, 1170 bp, Homo sapiens
aagaggtatttgagggagctgtatctcaatcctatgtcatgtggtaggaaccttgacttcctttaattcacctgattactgaatcatgataatagctaccattttttttttttttttttagctcttcccatatgctaggagctttagtatttattgtctcattcacaacaaccctgcaaggtatgtcttgttttctccattttacacaaaacacagttgaggcacacagaggataagtaactgccaaggtttcttagctggcaagtggtagagctgtatttgaacatgggtctgtttcgtgtcgaagcccaaactccacatttctggtttgtctctagcagattagtttagactaagaaacagcccaggcactgggccactgtgctcgctgactctgccttgttcacttggtgatgctgtgtgtgacagattaacactttataccttggcttacctatcagtcacttggggatttgggatttatgggaaaaggccctactcatgcagggtagagagattttaagagatacagctattagtaatggctttagaatcttttgcatgtagaaagttccttagactaccaactaatgagcaaagtgacttccaagtttaagtgaattctatataaagaatacaagacacccttgaggatataactgaggaaaaaggccctgaaattttagtatccttgctttggtggaaactcaataggtatcaaatgaaataatgaggtcagatatgttacataataccctgatgtttatctctggtaattaagtctgcagaaaaagacttattggaataaatcttttgtctctaaactctgctcatatgaaatagcaccatttggcaaaggccaaattcctggtggatatctcactgaggaagcaaacattttcaagaatgccagagttaaagggagacaacacacaccctaaacaagactgtgaagatactatgaaactattctgttgaaaccataagcatagtatcttttccagggtgagggggtttctgtaactctcttgagtgaagtcgctctttctgcaaccccccacttcacctgcattatggatttgcacataaaggagtttttctgaatcttcccttcttctacagaccaacaatgtttcctctctcctcagaactcccacttgagggagttgc

SEQ ID NO: 9262 - DNA, 2007 bp, Homo sapiens
ggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaactaaggagtgagtggctgctttaaatggagattcatggcttgactggaaggtggggaaggaaaagatttggaaatgattttgcatttccccaggaattcctcctgaagtggtcggctcggggtagagtgtacacctggagtcctggcctgtcccactcttgccctttcacccttccctgattgctgtccatggtgccaggcagggccactgtctcagccatggggagacgaggacaagtgtttatgctcagtttctgaagaaggaaccggttaatcagtctttaaacaataattcattgttgttttactacctagaaattcaatatagaaaatttggaaataagaaaaagaacaagggaaataggtaagttgctatccagaggtaatcaccgttaacactttgataaatagccttttgattttcatat

SEQ ID NO: 9263 - DNA, 1146 bp, Homo sapiens
tcttcctttgtttcttttcctagctcttcttgaaattagcctgttatggcctggcatggtggcttaggcctgtaatcccagcactttgggaggctgaggtgggcggatcgcttgagcctgggagtttgagaccaacctgggcaacatggcgaaaccctgtctctacaaaaaaatacaaaaattagctgggcatggtgtcatgtgcctgtggtcccagctactggggaggctgaagtgggaagatcacttgagcccaccatgtcaaggctgcagtgagccatgttggcgccactacactccagcctgggtgacagaccgagattctgtctcaaaaaaaaaaagaaattagcccattagactttacaatattaaattaatatttaacaaatatttaattaatatttaacaatattttaaaatattgttaaatgttgtttatcttggatgcttacttggtctttgagtagtttctagagataactcaaccatctgaatttttcaatagatggctgatcactgggaaactgcacctcgtcacatgatgcgtctagatattcgttctttgctgcaagatgctgctattgaagaggtgagtatcctttggttcaaatgcaatgcaaagtgatgttactttttcacctttttactttgaaaaacttaaaacctacagaaaagttatatgaatagtattcatacaagaacacctactgatatgcctttcattgagatcacggttagtattttgccacatttttctctgaatgcatgtattcttattaacattcttgttaatgatgtcactgtttttgtggaaccatttgagagttaagttgcagatcttataaaccttcacccttaaatacatcagtaggtatcttgtaagaacaagtacattctcttttgatttgatgacagttatcaaatgcaggaaatttagtattgataaaatactatattaagtaatataaatttcctgaattaaatttcttgaattatctcacatatagtttatattcacattttaccagttgtccctataacgtggtatatagaaattttcaaaaatctaagattcaatcctttaatataaaatatagtttctcagccttgtcattgtcatgaaagataaagaatttatgaagagta

SEQ ID NO: 9264 - DNA, 1164 bp, Homo sapiens
tttgctaaatgttaactcagtctttttttttttttttaatggttggtataggtagagatggaagattttgatgcaaatatcgaagaacagaaagaagaaaagaaagatgcagaggaagaggaaagcgaactggtaggagacagaccaaccactttgaacagtgtctctttattaaaattcttaaagaaggtttaaattcagatctgtggttagacaactactgttgatatacactttagtggtaaaagtttccataatcatcttcaaggagacttttggatactctttatttttccccagaccaaaagaaccctctaatgtggtgttaagagaaagttttaacagagtgctaagaaacttacccttgtactcatctatttgtgggtggttttaggggagtataccttttaagaaaatcaattacatatgaaagggcattcttacattccagcagatatgtggcacagcctacccaacatatgcataattgtctcttctttgctacaagatctccaaatttgagtttctgtcaacagaggcagaagaacttattgaatggggaggcagagggttgccactggctgctagatttgttcttctgcattttatcctaagtgacggggaaaaattaaatgactgtgtaggcaatggattttgctcaggctgattagaggcttacatagtgtgagtttaaagtttctgtgtacctaatgtaaaatgctttcgatcacacctctgtagagatgtttgcctttccctgtcattcaagaatatgcgacctatagagttacgttgacttttcagtgtttactgaagtacagagattagcaatgccttggaatagtgttgctttttaaatccagaatattactcggtttatttaatacttgagcccttgctaaagttgctcctcatattcttttgaaaatgtacaaaatgagaactctgattcctaccccctagagtatacagaatctccagggagtggtcccatcgaacccgtgtgtgatatagaggactcttgataaaaactgtgtttatataaagatggtgtcaacctctacattccaagatttcaaatgtggattaaaaaataagttttaaagttaatggcatttgagtctcagtatgtgttttttttaaatctagttttcttaagttgta

SEQ ID NO: 9265 - DNA, 1127 bp, Homo sapiens
acaggcagccagaactgaagggaaaactttccttgtaggcagcagatgcgttagagggcagagtatgtttttaaaaaataaaaggcagttgtgagaagacagttttcttggcaaactttgtttctgagtggggaagctttgcactgagggtaagtcctggtctttgaaatactgtaaatatgcagaggcaacatcaataggaaaggctctggaattaggaactttcttatgggctgtgctaaatctccttcagcgaggctggctgtggcttgctggagacaaacctatttacctttcctctctgtaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttttccctagtgctggtatactatagagaaacccctggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccct

SEQ ID NO: 9266 - DNA, 1134 bp, Homo sapiens
gggagcaggccccctagaggccatagtggttggagtccctggaggtcaccccatgcctccacagctggagtggcccagctgactgggcctctctctgcagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgccctttt

SEQ ID NO: 9267 - DNA, 1168 bp, Homo sapiens
ggtaatcagaggcatgattgcatggagtgtgattaggttcaaatgtggctctgtcaccgactggccgtgtgaccacaggcaagcttcttcacctctctgggcctcagtttcctaatcttcacaagaataatcagggtgccttcctcatggaaggttgttgagggttaagaagacagtgcttggcacagggctgggcacatgggtaagtgtttggtgaagggtagctcccagcttctcctcagcttgaagcaagcagggacccaggagcactgcgccctccccatgctccctgcccaagctcctcctctgggcctgccccctcctccataggaggagaccgcaccctccacagtgtgctgatacccgccccgtctgtgcttggtctctggcaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtc

SEQ ID NO: 9268 - DNA, 1414 bp, Homo sapiens
gcttagccagttagaaaaggatggccatacatggctagacagtaatgagcaagggggagagtggtccaaattgtaattcatgtggtgtgtcagggagggcccagatcttaaacttcaatcctgagtttgaattttattctgagggctgtgcagaggcatgggagagttgtaagcagggattgtcatgatctgaagtcatctcttctggtttgcatttttccatagcttcccgtccttggggagctaatatgcctgcattctcgagcctggaatctatatgctacttaattatgagagagggagcctcagttttacctttagcatgtgtgcttgcctttcaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccaggactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttccatagttggtttatttattgtcctactctgacagaactgcttgaaacagcagcagcagagccttttttgtgtttgcatagagggctgtagttagcgggaaaagtgtacaacatggtagtactggccagatgcagtggctcccacttgtaatcctggactttgggaggctgaggtgggaggcttgtttgaggcttgtttgaggcctggagtttgagattagcctggcaacatagcaagatcctgtctctacaaaaaaatattttaaaaaattagccagacatggtggcacatgcctgtggcctcgctatgctggaggctgaggtgggaggatcacttgagcccatgagttcaaggcttcagtgagctatcattgtaccactgcactcctgcctggatgatagagcaagactctgtctctaaaaaaataacaagtacaaatgaaagtatagtttcctttacaattcactgctcctggccccaaagtttgttcatagtctaaaacagtagttccaaa

SEQ ID NO: 9269 - DNA, 1192 bp, Homo sapiens
attatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatggtaagtacgtagtattcatgtgcatgagatgcttttgaagatgggaatgctggacaaggagtaagatcctcattatccaaagagattatctcaacagatagaacattttgaagaccacttataaaacatatgttgtattttcatgctatatgaagatttgctacgtccaacactacttttttttttttttttttttgagacggagtcttgctctgtcacccaggctggagtgcagtggtgcgatctcagctcactgcaacctctgcccccctggttcaagcgattctcctgcctcagcctccagtgtagcttggattacaagagcatgccaccatgcccagctaaatttttttattttcagtagagacaggatttcactatgttggccaggctggtctcaaactcctagcctcaagtgatccacctgcctcggcctcccagagtgttgggattataggtgtgagcccgcacgcagcctctaggtccaacactatttaaatggagaagtacagtgaaaggatgtcagtgtgtgtatatgt

SEQ ID NO: 9270 - DNA, 2417 bp, Homo sapiens
tgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcagtactgtgcttcagtaagcctgtgcatggaccttagtctctggggataaaacatccagattctaagcctccgtgaatctttgattctgtgagtctttatataaataatgttcttggaacagaaacaatgcaagggacatctgcacagaaatattctttgcttctctccagtttcttattcttgccagcagaatcattgctgctgctacagcttttttcccaaaaatgtctaaaagtgccgaaagtgcagagggagggaaaaaatgagccactaaaagaaggatgatcctttcttgtacctacctcctcagtctcagtgggggcctttccaagtgataatgccagtttatggtttgtaaaacttttccttcaaagagattgaactgaatttggtctccctggcatagcacagccaagttacaacttctcttggctgagcatttcactgaagtttaaa

SEQ ID NO: 9271 - DNA, 3479 bp, Homo sapiens
ctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacgaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatccaagtagagaaaataatatgtgggttaagatacatccttaaacttttttttttttggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaaccattttaggtgtactgttactcttgagtacttctatgtctggattggtgataattcttccatatttctcttttaaattatggcaaattatacctgatgaattagagaaaaaatattgttattcttcagttactgcagatcga

SEQ ID NO: 9272 - DNA, 1231 bp, Homo sapiens
ccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctca

SEQ ID NO: 9273 - DNA, 1193 bp, Homo sapiens
tatatggactggctggcccccataaccatttcagagggtggtctcagacctaccccgtctacctttagtcactactggccttgttttctgctcccagcccttgtctactctcctccaatgcacaataggaggctagaaagcagacagtcatgcttttcctccctggctgtctgaggatagaccaccatcatgaacgacacagtaactatccacactagaaagttcatgatcaaccgacgacttcagaggaaacaaacagtcattgatatccttcaccctgggaaggcaacagtgcctaagacagaaatttgggaaaaactagccaaaatgtacaagaccacactggatgtcatctttgtatttgcattcaaaactcattttggtggtggcaagacaaccggctttggcatgatttatgatcccctggattatgcaaagaaaaatgaacccaaacatagacttgcaagacatggcctgtatgagaagaaaaagacctcaagaaagcaatgagaggaacgcaagaacagaatgaggaaagtcagggggactgcaaaggccaatgttggtgctggcaaaaagctgaaggagtaaaggtgctgcaatggtgtaatctgtggccattgtggatttttcacaagaatattaataaactaaacactttcatgtgaaaacacaaaaacaaacaaacaaaaagtagacagtcatgtgagcaagcactctgtttgctgtcaatagcaataacaatcaatagatgtgaacaaaagagtttgccttcacctccgcaaacttccctcagaccttgaaagacctctgacattacaagatccaaaatgacaaccctggactgcaacatacccaagtggccatgactttggaacaagactaggctgaccacacactttatgactgtgaatcccaagtcaacctcagaaactctcagcctctctgggtgataccatatgatcagcctgtccagcaaacacaacctcctcaaggcctgagtcactttctagagcctttcgttatctgctaggatctgatttccactgctgaaatactatcattgttctagacctggactatccagctggttatgtttatccaactagttaacctaggggccattgcttatgcggccatctataagtataaaatatacatgagtttccaaagacttagtaatgaatgtaaaa

SEQ ID NO: 9274 - DNA, 1235 bp, Homo sapiens
tatttaaggtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgag

SEQ ID NO: 9275 - DNA, 1266 bp, Homo sapiens
ttataaacttatttgagaaacgttattcatcagaataccccaggagtgcaaaagagagaggaaaattatttacccaccacaggattcatttacattggatcagcaagcttcaaatatctttccctagcccatctaaactcttcccagaaaggaatgagaagagagaagggaacaccaaatccatggcttggtcatataccaaaatttactggagaaactgaaaacaaccagagttcttttggtaattcttagccaatggccctttaattctgatactaagcagcctgtccaatgatgaacaactaataaaatatagaagactaaagcaagaaggtcagtatttcccttaggagactggcagccagaagaacaaatgtgacaccaagctccaaactaaactgatggcctgccaagaagtactcatgtccatctgcttctaggactgtgatacttggacctgccacagttataatatcactttccttgaacctcattcattagtatcctttacaatccaccctgaacattacatggcaaaatgggaccatcagcaaaagaagccttgggaaagagcccatttctcaacattttgatctctgttgcagatacagccatgctgagcctgagctgtgtataagcgagggatgactgatgctgtgctttgtgattagctgaggcgatgagacagcatgtgtgtatggacaaagaggacagagtggatcagagggtctcagaagtccagctcctatgacacgactgtcactgctgggaagctgcagagtcaggcccaccagcctggcatgtggccgatggcagtgggctgcatctcttgagcagaagaattaggttgtttacaaagtgaggaggcagaaccccacaggcctcagccctcacctgaagcatgctttctttttattgcaaatgcagtgcaggcagcagaggtcccttcaaccataatcacgaacgaatgtcatcaccggccatgacagtcctagaacctcttcatatgtgggtttagagaggcagtcaggttagagaatttgagttgtgtttgcattacatgttttataaaactgagaaaaacgtcagttgtccttatcagagtggagggagctgtgctgaaggatattaggagcaaagcctgtgtatgacccctgtatgctgcccagggcaagtgtcatatttaaatacctacattgttctttgttttcttagattctgtatttgtctgttcatcagagggctaattatattaactatattttc

SEQ ID NO: 9276 - DNA, 1105 bp, Homo sapiens
accccgtctctactaaaaaaatacaaaaattagccaggcatggtggcgggcgcttgtaatgccagctactcaggaggctgagtcagagagaattgcttgaacccgggaggggaggcggaggttacagtgaaccaagatcacgccactgcactccagcctaggcaacagaacaagaatccatccccaaaaaaataaaaaaatagccaggcatagtggcatgagcctgtggttccagccacttgggaggctgagatgggaggattgcctgaacatgtgattacgccactgcattccagcctgggtgacagagcaagactctgtctcaaaaaggaaaaaaaaaaaaaaggatgatcaaaactatggcactaagaaatcatccctcccatttgtttttctcagaccttgtttaaaattctagcttatgatatgatgtctttactttaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagaggtgagttctgaggagaccaagaacttaatgcttttatggttctccttgggcagagcaatcaccccctagcaagcatactcatgccttcaatcacacattaactatctgaattttggagctagctcaaggattttctagaggagtcaaagtaagtctcaaagcttaaggttctctccattccttcctaaactaatccatggaaactcctgggacatatatattatcaggagattccttcagcttgccattgccgtttgtgccagatttagtgacagctgcttatcctgatgtgaaactaagaggttattgagtatcggattttggaagagaacagatttcaataagaacattcacatacatattcttattttcagtaagagtattcacatataatggtgtttttaaaacggatgcttttaaaataatttaagtagttttattttaatgaccctattgggactttaacacaaatatgtttcctttt

SEQ ID NO: 9277 - DNA, 1177 bp, Homo sapiens
attgtctgactcgtggattcagcatttcagaatatggtactctaatcttaaggctttgaaaagaaaccatggccattttttcttcatattttacctttattaattgggctgggtcctaactggttgccagagcccagaaatccaagttctgtcttttcagggaatatgcatagctaaagagttcattgtgtttgcaaaggtgtactaggagttctcatttcctcagatgctcatgtctgtaggctgttaagctctcatttcaatttttgcagtcttttaaaacaccacacttcttttccatcttgaagaccagttaaaactacctctggccaaaaatgttagtgttactagatattatcaaggtgtgagactaaaaagttagaaggctttaagatgtaaattatataagttaatgttttctttccctaaaagttctgacccttgctgacccctcaatcaaatgtttttaattgaaaggggaaagaaaatatcagagaacttaaagatggccttcgtgactttgactcaaaatcaatgcatttcattatgtatgggtcctacaccttgcttcctcaagtggccatgaaaaaaaatctcacgaccatgcaaactgatgccaccccaaagtcatggtaacgatttgaattgctctcagtattgatgtcaaactccctcctgttgtcagcagcttattgcaaactggccattctaaacccttttacccccaccttctctcaatcttagcagttaatctcagccctcccccaccacataacagcctcgggcagaacttcccacttagacacccacacacacacacgcttccttaccttcttgccagtgcctgtcctgcccaagacgaaccccttttcctgtgccctaggacctctcccttgataaatgacttgatctagctacagcctcacactcctggcacatacagctttgcatttaaacatgttcagatactccttccttcaaacaaaagacctttcctcaaccctttgaaagcctgagtaccactaaggtatactgcccttatctgcactctgtccattctgcagtctaccgaggcagtggtttttaaccctggctgcatgttagggtcacctgggaagttttaaaaagtcctaattcctggactggaccacagaccagttaaatcagcatggggagg

SEQ ID NO: 9278 - DNA, 1169 bp, Homo sapiens
tgagataaggtgttgctctaccacccatgctggaacgtaggggtgcgatcatagctcactacagccttaaactcctgggctcaagcaatcctccctcctcagctcctgagtagctgggactacaggcatacaccatcatgccaggctaattttttttttttttaacagatggggtctccctatgttgcccaggctggtctcaaactcctggcttcaagcgatgatcctccccgctcagcctctcaaagtgctgggatttacaggtgtgagccaccacacctggtccgctgaagtttattgatcaaaataaagtttctttgaggcctccgaaggttttggaggtaatgccagaaacttgctcccggctgcgccgaggggagaccagctgaccttctccaccgttgttttatcgcaccaaagccttagcatagagcccttcccagccaccctacctgcggggctggacccgcccaccacacccacagcaccttgctggggctgacttcccgatttgtgtccacaggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaaggtgcgtggtgggcctcaaggagcctgggcgcagggttgggggtggcagccgtgcctgcgggtctggcagaagccctaggaattcccagagactgccaattctgggcgctgttggagcggtacttctgtggggcgccttttcccttgctcagggcttctcattctggcactggacagctgcaagactgttgttgagatgacacgcgttccccaccccctcagctcccccatgcacag

SEQ ID NO: 9279 - DNA, 1240 bp, Homo sapiens
gggccctggaaactccccagagtggccgagagcacgtactgctgcctcctggttccagtatgtactcagtcactcctttaactacaaatgcattgaattaaacaaaaagcctctacagacgtttggaaaataccatagagctaacaatcataatgataacaacaactgtcaacattgactgagctctcattttgtaagtcttttccgtgaattccaagtctgaggcattccccaaggggaggacagtgagtcttacgctacacagggaaagcctgggggcaggatccaggggtgccagggacaccccgcaaccagccacgccctgcaacctctgcccccagcgagccccagggaggcccctggtccgccctcctgacctgctgctgccctctgtgccccctcttcctgcaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccggtaagggcggcggcggggcctggaaggggagcttctagggctctgcatgggcctaatgagcccatccctggggcctgtgggcagggctggctgccatggatagagatgaaaggaaaacactgaaactttttattactgaagattgtccaaggggtggcctgcagataaaaagctggtgatgaaggctgacactggctgagcatttcctaagcctcagacatccagactggcacactggctaaggacatgggttctgaggccacattgctaaggagcaaatcccacgtctaccaactgggcaagttgcttcactctgtgcctcagtttcttcatcagtaaaaggagggcagccaaacagtccctactctacaaggctattgacaggatttctttatacataattatattgcttgcaacatgcttggcacataaaaagcactcaattatttatttatttgtttattatagacggggtcttgttctgtcgcccaggtaggagtgctgtggcttgatcctagctcactgcagtctcaaacttttgggctcaagccatcctccc

SEQ ID NO: 9280 - DNA, 1224 bp, Homo sapiens
tgtgcatttcctaactcccttgccccctcccccatctgtggcctgggtgggcactgctcaggctggataccacctggaggttttccttccgcagagggcaggtacgcaagggacaacagtatctttcttccagaggtcctacctgctctgagatcctctggggccggtcaagaggccccataccttccacagtttccactcagctttcagccagggggtacccacaggagagcagcggctagagctcaagtgcttcctgggcaccccacccctcggggcctacccccctgcctgtcacccaccgcgccggtgtccacctgtcctcctcctcttctcctccccccgggagtcccccgctacttcctgaccctacctcagagctcactcacccagtgggttcagccagccacagcgactccaggggctgtagacaggaacgcgctggcacagagaagagcggggaccacaccatcctcccaagaaccctctccctcttcctgccttccccctctccctgaagggcaggtccaggccaagtgagcctgtgagaagctcaggagcctggctccatccaagagcaccccggggggaggatcaggacaggatggacagaggcccagactcatctttgccaagcacagaaaggccgagcagctgagataagtaggcaggggagccccaaagggagggaactcagcggggtggcctgcctcatccttcctggcttcccttccctgcactcagcatcatgccacagggctagtgtaccagtgccacaggaggggtgccctcctaccacacttgggctaccagaggtttggtgtagctcccctgggcaccgcgagcacgccagctctctggcaggacccctgcagtccccctggctgtgccaggtaaccaaccgtcttggtttgtccaggacgtttctttatcccaggaaactcctctaccccaggcacacggggacagtgggtcactctatttctgtggatggccgtgaaagttttcactaactcaaggggcagccctgaacacccatttgtgctcacaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagat

SEQ ID NO: 9281 - DNA, 1449 bp, Homo sapiens
cagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaaggaactattgagtttcttcacacattgtctttctgggctgactgtcccccagacagcactgcccttgggtttcaggctgaggctaggagaggccgttgggagaggcaacccagccttagtgttccctgggaagtcccatggtgtcattttaaaacatgttcaccagcaaagctcaggaatgcaactggagaagtatgctgcaggtctgagaagctccctgttgcttttatgcttttaatattaatggtaaggcaatcgattactttcattaatgccagagaaatgagatatcagatatatgtgaatgaaaaccaattcattaccttaggattttgaattgcatctgtgacacacacaacaccggatagcacagcc

SEQ ID NO: 9282 - DNA, 2052 bp, Homo sapiens
cagactaggatgcttctgccccaggcctgccttccattctttaacagcccatcttggcttggggttgcaatgatggctgggccagtcacttgtggcagggcatcagggccctggcagggaagaacctaggcacctggggttgtccccagcctgcccgtcagcatgagatacccagtgggaaagtgagaggatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaacggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgaagggctgtgtggggactatggctacctgaagagggcacaccctgttaaaggggccacagctgctcagctgttcttacagtgccggccctgtgttgccagattgtctgctttgtcagaggccagaattctgactttttatgtgaaataggatttttaaatgctggtgatcacttaaaaaaaacttaaaaacccaatactggcaaaagaggatgccagtttgcaatccctgaagtagagagagctcgtgctggggagaagtccaccaagatgctttgaggcgggctgtagcaaagtcctgtttctcagagctgggctgggctggggtaggatccttgcagctgaggaggaggaaaagccactgagtctcctcccagagcgggacaaaccagaggccctttgcagttgctgggtcaccagcgggggtggcgcatggagtacagacagtgtagctcttggcctgccagggagacggatggtgcctttgaagcaaagaggaagggaaggcagaaccagggatgcctttgctgatgagagtgcctgtcagggaaggcgccacaggctggcagctcttcaaaccagcagcgcttgacccagagccagatccagcatggcctggccagaggcaccctgggaggccagctggtcagtcccttgcctccccaagttccccctggggtcaatgagccctgggaggatgcctaacctaactccagccagactaataggggcatggtgacccttgactcaccatcccatcccagctttcagggagtgggggtagtgtggtctccatgttcctactatgcctaagaagagatggctcaccttgggaggtgccaggctgaaactaggtcctttccgggtctggatgctgccgctcaggagcaggggcgtggcctcagctgcctctgggagcttcccgggaatgacagggtttgaggggagtagatatgagagggagccgctcctggttctggagtcttaggaggttccaacttgcaggatcctttcccagagccctccatggagaaaacagcaaaatgaagcccttacctgcttgctgtctgcaagggagggagccgagccccagctgataatcccccagcactcacccttcctgagctgagacttcggggctgtggagaccagcacaggacatagtggtgctttttaaatttatttttaactgtttctcatatgtagcaacccctcctcccctcctgggcatgtttacacaggctctgctctgggggctggcctggctgtgaggtttctggggaggcagagaggcagggactttggggccttagtcaccatccatggtatcacctcatctcacttcctgtgagggacagggcctggctgatgtgatcccagctccccccagttcaggactgtctttcagctcctttgcccctggaggtgggggctgctggctgaggaggggtcaagg

SEQ ID NO: 9283 - DNA, 1242 bp, Homo sapiens
agccacccctatccctcttctagcagggccaagatggggacagcagcagccctctggccttgggatgtgatgataaagcaagcctagggccagggtttggggagcagagagagccaagaagttgaccacgtgtgatttccagcccttcccactgggacttgacttcccaggtcaaggagtccgtctcattctggctggtcgagtgaccagaggcctgtgtgaatgtgtgcacctgcttttcctgcctggaatgttttctggctcagctgcagcaacatctgtgagcccagtgtctgccctgtgtccctgggctcgctccaagtgcaggaacatacatgcagggcccaacatgatgatggtgtgaagggcaggaaacagtcctctgaaggagtggggaggtgggcagtctgcccccgccaggtaccatcgcctcctgccagcttccttagaccaggcagggctgccatggtgctagctgcaagtccatcagtattgaccgtctcgctccatcttggtcctccggagtcccaagtttccttttcatcaaatctgacaagagagaagaaacatgggtgtgcttggcccacagggcctggtggtgatggacctccccgctccctcaagctctggatggctgcagtgttgtactagactttgttcaggctgttctcatctcagtattgccccttcctttcactttcacacttcatctcattcctgttgtcactttccccgaaacgaataaagtctccccagctcctgctgtgtaggctgggcagaaaccacaacacgtaagccttgtctcctttcctttggagctggggcccgagccctcccccagcccagcggcattagccccattggctctgggaagagcctgacctgaggtgagcctgaagccagggaacaggaaacctcccagcgcctgcagtcatgatgaaacttctggggttccagacttcctcagcctgctgaagcccctcaggccttgttaaccctgatctgtgagcagtgctttccccctcttcacacagtgggcctggcctccagaggctcaagttagcacccaggatgtattccaggaccctgctcttccagtctcagtccacagcagtccatcaggagcaaaggagaaatggggcatgttctcctgggagatgagtgtagctcaggaaaccgtagcaaccttctcatcacttgacatccagaacccatggggtggaaaacacttcgggtcccatc

SEQ ID NO: 9284 - DNA, 1262 bp, Homo sapiens
tacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagctggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctctt

SEQ ID NO: 9285 - DNA, 1220 bp, Homo sapiens
aagattcttaattgtacatggtattattatcccattttatttatttatttatttatttatttatttatttatttattttttgagacagagtctcgctctgttgcccaggctggagtgcaatggcacgatctcggctcactgcaacctctgcctcctgggttcatgtgattctcctgcctcagcctcccaagtagctgggattacaggtgtgtgccaccatgctcggctgatttttgtatgtttagtagagacggggtttcgccatgttggccaggctggtctcgaactcctgaactcaggtgatccacctacctcagcctcccaaagtgctaggattacaggcgtgagccactgcgcctggcctatcccattttatagtaggagatattgaacccaagagagttaactaacttgccaaaagtcacacagctattaagtggccattgaattgcagatctgttttacttctgatgacatattgaaaatttatgcccttacagggcaaggggattctgtctattgctgctctatccccagcacctagctagtgtcttttggctttcaaatatttgttgttgttaaatggcataaagggacttttgctacacacgttggagatgtgcagatgactgatgttgccgaatgtttcccctactacgttttgtccgttcccaggctgctcattggctttgaccgaggatggtgacgtagatacggtaaagtgctttggtgctttcccatttggtttgaccctgtggttacccagtaataggttcaggatattagaccttgatccagaagatccaaagatgaggataaacctttaaccattgcaacttaaagcccctgagagttgatattccctgtggaggagaattgtattgatttttcagaggtaaaatttagggaaccacatgttcatactattcgattccccttgattcagtctcttacccctcctcctgtttcatggacatttcagtgttgccagtgaaaaagtaatggttttaatttggtccttatttttaacctgcccctgagacttatatgcttgtttataccatgtacgtagtgtgtgattgtatgtgtttgtatttgtccacatgtcccaaaacatgggctgttacttcctttttctatcttggtttccttattcccacccttctttttccacccaggtatctggacaggaagacttctcccatcagctttaccagagg

SEQ ID NO: 9286 - DNA, 1097 bp, Homo sapiens
aagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttttgccaaggccagtgttgctgcctaaaaaaaaaaaaaaaaaaaaaaaaaaaaaaaaaaaatgctataaaatggtgaaagcttccttctaaactgccccaagtgttgaagtcttcactttattttgttgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaactgcgctgagtcagcaattttgtctttctagggctaaggccatgcaactccgacgtaggcgacaccctccctacctccagtatagaacgaaaatcctagtgcttttgaaagccctgggagctggcctgtgggaaaggccctgtgctgccttgctgcccctccccctcggtaccaggctatttaaattcacctcttggggaggcgacagttgctgactaagcgatttcggtttactcttcagcatctctattttcccccggatgcgggcccagctgcaaatggcattgtcaagaatgctttctggtgcctcgccctgtggcggtgaacataggctgacacccagtgcagctggtgacttgacaagtgggcgaaaaagtctaggagaaaagctaggatgctttgcttcttagatatgacagacatcagtctgcatatttaaaacaaaactgccacag

SEQ ID NO: 9287 - DNA, 1167 bp, Homo sapiens
tccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgcccgtcggggtcaagacagtggccctgtcggctaaggaagcggcggcggcggcggcagcagcggcggccgccgccgccgccgcgcaacagcaacagcaacagcagcagc

SEQ ID NO: 9288 - DNA, 1182 bp, Homo sapiens
agtcttactgtgtcaaaaatctgaaaacacttgctgagaaccaaatttattccattggaaaaaccctctgtggagctataagcctcttggactcttcttcctagattaaggcttgcatttccctccctgtttcagtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagaagccatttttagctcagagcaacccttaagagaacttttggcagattttgttggcattattgaaatatatatagaaaagttgctgattgcaatggttatgggaatggaatttaatgacatttgtaatttattacactcattggtttttattgattatagtattgtctgactttttattttctactatggttcctttagcagaaaagtaacttttgtgcatatattgaagtggtttttcagctatgaattctttagggtagaaatttatttagcaaatgtgaattcttttgagaaagtatgaagttttgcagaaattgactgtgaaatgtcagagaaaaataaaagtcacttacttgaaacctatttggcctttttgctttataactgcttaaaaatactgagtgaacctggagtaaatatttgaactgatttaaatgttaaacataggtactcatgttatttgggaatattgggattagacactgaacatgtggaaattcattgctcagattttcactggtgtgaacttgaaatatgagtagccttatggcaaatgagtagtcccctgttttctggagccttggaggcttatactgggcaggttgggaggagtgagaggtgaagatagtccagtgatttcttccatctgattgacactttcacaaatagaacttttaagtgacaaagctact

SEQ ID NO: 9289 - DNA, 1135 bp, Homo sapiens
aattgcatttctggcagggaaggagaggagggatggagaagctctgctcgctgcttccacctcaccgtgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagccaccttgcatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaatgccttgttgtccttgtacttaattgaatccgacttgccctctgctcccagaaaggcctccctgagaagaatgttttgagtgcaggaaccaccccgtgtgtcatgtctgaggctgatctaattccagcagaagacctgggctgggcaggtgagcctgattactccaggaggcatttggatctccccatgtgtacagttacttgagtaatgttggtcgtcattttggtatatttaaactgattccaaaataagtaggaagctggacctctgatttgtcctcttttaacctgttcacatggcatagaaaggagtgcaagaagaagttgtccccttcccagacagccgagtatcccagtgctgtagcaacttgccattctgcctaacagaggt

SEQ ID NO: 9290 - DNA, 1227 bp, Homo sapiens
ctttgggcccttgggggcagctgggtgtgcgatctctactccaaggtttaaggggctcaaagttaatttctctggtacttcttcgggagccagcatttcaaagtggaacccaggaaagactcgccagtgattagcactcatgaatcttcccaccaaaacatgtgtatccctatggataggggagaacttgaaagaacttctcagatgccctgtttactacccctctgactatagacatttcaccaaagctccctctcccctctgccacccctagcatattaagctgctctctgaacttgctattgccatccctgtactaccaactcagtctgctagatggcaagggtgtaagtgggaacctaggcccttccaagatggttcccaagcccagcagtcccagcctgtcctgaaggtaccttttgtggagaaagtaaagatggtcctggcacagaaagcaggtgatgggcagaaagtgtctttcgaagaggaggaattgggtggccacaactggatcttccttatttggagatgcaactccctttccttacctagccaggctacagggactcctggtgccaagggacagggactgctggtgaccactagagtgtggcagacattaattagcttagaatccctgaagaaatgccttacctaatggctaaatgcctttggattacacctttggatctgtactacgagtgaccagaagcatggtaaatgctgctgccctccgtcacgacccacaagcaggaaacctgaaatctcttaggcaatttctgccttctcttaccagtgataactatgtaaaccatgccccgttcctttctgcacttgtagaactaaactttaagcccaagtatccatctcatcagcactcctagaagacctgtgtttccaattcaaatatgcattctgattactttagcagattttatttttaaaccatgtcttacacatgatttgagaaaaagactcctaaaatcccatttggaagagggaggactatacattattaacgtgacgcaaagtcccatctaacgtgccaccttccttagtgccacaaaagtggttctcaaacttcatggcacgttaagaaccatctagaccgcttataaaaacatgcagattctcgagcccgttccaccagagatgaacagagtggctctggagcaggccccgggaagaacatgtgaaagccgtgaagctccccaggtgattgtcatg

SEQ ID NO: 9291 - DNA, 1075 bp, Homo sapiens
tggtgtacccattttcccttaacgtaacgggaagtgttttgaaattcccagaagagagctgttttgtaatcaaagtgatggattataagaaagccagactttggaaaaggataattggaataaagggaggtgcttgaagattttccaaactactttatgtcatttagcttctattttctgaagggctttctttggtgccatgtactcagatcagtcagttgactgaaagatgatcatgttttcttcgtaaagatttaagcaattggcaactacaaagacattattttcttactgttctatatcatgtactgttgctgacattacaaaaagggtctggaagggaaaccgtgtcactgttttatcttttttctttaaaatacaaaagtatcccaactaatcatttattatggtcagcttgttttacatgtcccctatcatgagaaatgctatcaacatctgtgatttctaagagtcttaccaaattgttactttaattcttgtgtcctgctgagtggtttttcttttaaaataccatttttatcaccctgtggcactgggtgtgttactgcgattacactgatgattctgagctgtgcttcttcaagtagctcagttcttgcgttttatattaggtaacagttttgtgatgcttttgtgcattctttgtcatctcttctgagttttcgaatctgtcataaataaactttttcactatgcacctggtaacatctgagttatattttaatgaacctgatttacattttaaattctttgtctttcatgtatcttccttaagaaaggtattctataagcccatatgaattatttcataatctattaagattgtgaaagttaagaagaactaaaaagaaaaaaaattgagaataagattaataatagatctttcatctgcatttaaattcatggcagagtatcatgacctgggaactgggaatggaaaaactgggtttatagtgatgattaataagttctgagttttatgtcagcatttggtcccagtgaggcctgtttccccatgaagatattctgttcaaatttggaacctcgacttcgg

SEQ ID NO: 9292 - DNA, 1148 bp, Homo sapiens
aggaatggtatcatctgacagagaagatgaaaaacaaaaaacactccagagtccccaccgcttttttttgtctttagagtaggagtgctgtttagaaatgttgctttggaatcaaatgcagtgaaacccaatcaggtttccaaagtttctgcatttagctttcttgcattgagggcttaaagcttttggtgttcaaagtcccttagtttaggtgataatgaagcttcactattgctgctgattgtatttgttctttacctgaccaaagcttgcatttccctggtgacagcatttcctactgtgtcacccctgaggctcaggagtgccacagagtgcaggtagtgctgcagccagtggtcaccagagcaccagctgctgggcccccaggcggaggaggagacggaggtgagatgggacctcagcagtctctgtgtttgtacctccctgtctcttactcctcgtgttatgtctgttactgcctacgaattctgaagaataattagatttatttattactgtatttatttttttagcacatttcattttgcctttgaaacagtttccatctgtttctcagaaggcttcccatctgttctgagccactgaagccccctcttttatggagttaaagatgatatttttaggagaatttgggaagcgatgatgttttatttctgtaggtcagtcctgtgacggctttgcgaggagtatggcccttcagagatggatgatgccaccttactccatgtttggggtacagtccagcactccccatgaaaaattctaagttgtgagggaatctgcccatttgctggagattgagtgcagaggaattccctaaccaatcagagatatcccgtgattccaggatttcagagtcctttgtctcctctgaggtgtcaccttctttgtgatgtttcctttgactcattgttagattcctcacaccaagggtctatccctacagtagcataactcaaggaacgggactcttcccagtgggtccctagtagcatctacatcacatcaaagggcaatatatcctgcacctgctcttcccctcggagcaaagccccaagtgggataggatgttggggactgccagagcattcccattctctgagcagcatcatacctccattatttta

SEQ ID NO: 9293 - DNA, 1986 bp, Homo sapiens
attaaccgggcatggtggtgcctgcctgtagtcccacctgtgtgggagaatcacttgagcctgggaggtcaaggctgcagtgagccatgattgcacccctgcactccagcctgggtgacagagtgagaccctggctcaataagagggggaaaaaaaattgttaggagctgggtgcggatgcagcctgcaatcccagctacttgagaggctgaggccggaggattgcttaaacccaagaatttgagcgtagcctgggcaacacagcaagaccccatctaagaaaaaaatgttttttaaatcagcttagcccaaaggggttgtgaatggggaggtataaaaagcaaagattattttttggctactaagccaagaacttacagggattttttttttcagtcccagaacctacagataccctgctacttgcttcacgtggatgctcagtgcccagcagccatcttaatacattaaaccagtttaaaaaataccttccatgtggagaaaaacatgtctttttctcgcctcaactttatccacatgaaatatgtgcccatggctgggcgcagtggctcacctgtaatcccaacactttgggaggctgaagcaggcagattgcttgaggccaggagttcgagaacagtctggccaacatggcgaaacctcatctctactaaaattacaaaaattagccgggcatggtggcacatgcctgtaatcccagctacgtcaggaggctgaggcacaggaattgcttgaacccaagaggcagaggatgcaatgagccaagatcacaccactgcactccagccttggcgacagagggagactctgtctcaaaaaaaaaaaaaaaaggtgtgcccaggcccctagccattgccatgtgcccagccagagagccaaattagagggctggcttccctatcacacagaataaatgctagtgctagccaatgatccctttgcttttaatgtatagaaaatactgttgttccttttgtcatttccagtgacatctgttttctaagcagctcttttctagggaggaaaccaaaggggctaggttaagaccctaatagaaatgttttttctaatctctggtgagtctggaagtgtcacattcacagtccacccttgggagtggcttggtggagctggggacaaggttttgtttactacatagtgcacatgataaatggccttaaactgtgattctttctggtaggataagttataataaactgaccctaaagaatgcaatggcttttaaactgcagttactgtgttcttaatgaagcaatacccaaagctctgttcttttggagcacttgaggggagcttgaatgaaaggtgcagataagagcagtaccttgatcttatgctttctgagtgtcctgccttgttgccatctgcatggatgagtgaatgcttctatgcacgaggagactcaagccaactcagagtctgctttttccaacgctcttcccaggtttcttttgcaaagcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgaccaagttacctgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtt

SEQ ID NO: 9294 - DNA, 1077 bp, Homo sapiens
gggaggtcacagctccagtgagctatgtagcactttgtgagaccaaggcaggcgatcacctgaggtcaggggttcaggaccagcctggccaacatggtgaaactctgtctctactaaaaatacaaaaattagctgggtgtggtggcacatgcctgtaatcccagctacctgggaggcggaggcaggaggatcactggaactgggaggcggtggctgcagtgagccaagatcacaccactgcactccagcctgggtgacagagtgagactctgtctgaaaaaaaaaaaaaaaagaatccaaagttgttatgaagttcatgtgctaccagttttttaatgaagactttttaatttgcagttcagattgttgaaaatgtgagctgtacattagcaagggtttactgtaaacatgttatgattcagcttttgataaacaatgtttacacttttatttaatgtcatccatttttccacagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacaggtgccaagccatacaactcaatttcagtgtttacactggtgaaagcaaagtagttcatagttttttctccttttccttagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaatt

SEQ ID NO: 9295 - DNA, 1165 bp, Homo sapiens
ttttctaaatgatacagagctagtgtttcttgcctctttatctcttttctccttttttctttccctttttccaggcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtccatcataactcactggcctcccacctgaccccaggcacgtgcccttccagaatgtgctcatggtcctcgccaagggcttatggttcctcttggttgctgcttcctcagggtttcccagggagatctagggaacagaaggccaggggctgtttggtgggattttccttataggttgggagttcacctacaatgcccattaggtcagagtggacctgaatcgagtattggtgtgatcttctgcttggcttcttgctcctgtaatccttccaacctgtggggccacttccactatggggccacttcctgcttcttgggggtttctcttaccttccaagactcagactctg

SEQ ID NO: 9296 - DNA, 1264 bp, Homo sapiens
taatacaaatacagtgtgagccactcaggtgaatttaaattttgtagtacccacattaaaaaagtaaaaagaaactggtgaaattaaataatagtttatttagcgcaatatagaaaaatgttttcaatggagtaaatataaaacttattgagatttttacttttttttttttgaggagtctggctctgtcgcccaggctggactgcagtggcgcggtctgggctcactgcaacctccacctcttgggttcaagcgattctcctgtctcagcctccggagtagctgggattacaggcactcgccaccatgcctggctgtacattaaaaaaaaaaatattttaagtcatcaaaatctcttgtgtattttacatgtatagcacatgtcagtttgacctggcaagagctagagctcagtagccatgtgtctagtgactgctgtactggacagcactagagataaggttaaaactttggcagtttcacattggcacacataaatttggttgtgcctatgactcatttcatgggtgatggtggctgttttgttagaagagtgaagtgtgcactgtgcctatgttctctcagcgtatcttgtctgccattgcataacctgggtctctttgaactgtttcttgacagtttattttgattaactttttcagaataccttttttttttcttgaaatggtttatagatgtattcccagatctaccttttatgtagacaactcccagttctctggatcacttcctgtggattcttacagattgctttgaaagcagtcacaattaattgaaaatatttctgtccacagctcttttctacaaccaaaggcattttattcttatttatttaattgtagcactgagtatgggaagaactgggcatcttataaaatatttcctttaggagtgttagactggcttggaagtataattgggtcaccacattcagcagtaacatgttaactgtattacctgacttagttaccaacttttagacatgctcatacatagtactttttggctagacttgggctgcggttcacactggagcatgaactctctggcaagccccagggatgcccaggcatggatggaagtcaccagtgacaatatgtgggctgggcacttggatgtgaagaattgtagtgaggtctcttgggcttttgaatcattctaggagcattttctctattctgtgttatgccatagtctgtacatagggacttaattttcatatttcattatttaaaaatgttta

SEQ ID NO: 9297 - DNA, 2527 bp, Homo sapiens
aaacttcccttttgatagattgaactgaaactgcttattgtatgtggttatatttggtaaaagttgcgtgtgagctttttacaaaagggtaagaattgtgttgaattttaattcacttgtataagaaaacaatttaaaactctcataataggtcttaaatatttttacttgctattctccctcagtgatatatacctcttcctttccagctttatgaaacatctatttaagatttaaagttatcagtgatcatagtttggagataaaatttgacccaggaatgaatatttattttaattaggttttcatacttattaaatgtaattaaagacttgggtcttgtctgagttcagtggaattgaaaccacaactttaatttccttacagaaaaacttaatttgtttcttttagtgccacaccttaaaaagaaaccccaaactagctcctcaggaatatagttttattttgcaagcataccatctagctgaaattgtatacacatgaatatatgtagacttttcctgttgggctgaagtgtgtgcttataaatgtgtttagtttttaagctaaacattcagttaacagtctgtgcattgattagcatagggcaggtggtgaggacctggatttttattaaacagtttagtaattataaaagtttcttgtgtttactagtaaagaattttaaaaatctattctaattcaacaagtttttaaaatcaactttgtaatttgaggggaaaatttggggggaagaggtgggtgggccactaagttacctctctttcatttggtggcccttccaggccattgaaaataaagacgttggctccagtttgcacattgggaagaaagcatagaaatttgacttgtatattaaaaataatagaaatgtaatatgtatattaagaatgcataggtctgtattctgtaaggggctctgaagaacaatatggcactgctgtgttcagtgtgaattcactgcctgggagaactgcaggaatgcttgtcttcaccattgtgttcttacaacgaattcaactttccatggtttatcttgacaaaatttacatgtgtttaggttacttgtatattgatatatttttttaatcttcagtttttgtcttccttttgcctttgtgttttcagaagtaacacatgaacactttttaaagtacattacagagaagaaaactgtgagctattatatagtgtttcttttttaacacaaatcttttaactttaaaaaaaggcaaaaattttttttttctacttcccacccagcttaccaccttgatctctttaacttatgttctaaactttggtgttaatggtggtgtctagcatgctagtagttagattttatttagatgccataactggtaatacagcttttattttgactatattaatttagttttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtaggtttgtatttactcagtaaggaagtcagtgacctgaactacctataaaaattcagcagtgctgcagtgttgcttaagtgaaaccctttggctatctagtagtttttatgctactgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgt

SEQ ID NO: 9298 - DNA, 1170 bp, Homo sapiens
agctgggactacaggcatgtgccaccacgcctgactaatttttgtatttttagtagagatgggatttcattatgttggccagctggtcttgaacttctgagctcaggtgatccacccgccttagcctcccagagtgctaggataacaggcatgagccgccgcgcctggccaaaatagcataatgttttaagaaagtttacgaatttgtcttgggccacattcaaaaccatcatgggccaagggttggacaagctagccttaggtcatgtccagaatgcaatttaacaggaatttcaagcaaaactaacaaaaaattaaatccacaaaaaaatatcatttggtaaatgcactgtctcacacactttactactaagtcccattcaaaccatgacgaccctttacataaaattagggcattctcaccaagtttctaaagatgatttctaaacattaccaaggtctaagtgctaattccccacaaaccatttcttatcttgtttaaatgagactggctttagatatcatgactcatatttatgtgtttaaggaattaaacgtgaaggagatgtataaggcaaccacaaatgtagaaaacaaatgtatgtattagtaatattctcccatgtattaactagaacaagaatgtgagatttttacatttcttctagtgtgccttagcaaatctgctggaaagagtctagttgttttgagaattgaaaaaaaaatgtgtctctcaatttgtcaattctaagcctgtaaaggcagaaactatccacagtaatgagtttggtagtgcctggagagaggcaaatgatcattggatgtaacaaaagctacaagagaatagactaaaaaaagaatttcaatatgaaaaagtaaaatctagagagatgacaaatcagcattgggtaccaagcctcaaaatacttgaactagaagccatctcttaaagttaaaagtaagaagctccaggaaaaataaagattgcatagtaaaaagggatagatggcaggattaattcaactcaacaaatatttatcaaatgtctactctggtcaggtgctgtgttagcagccagcttccctaaagggaggaaaggctagacacgaggacattgaggattgtttatttaaagtcactcataggcatgccataatggatttattaagg

SEQ ID NO: 9299 - DNA, 1105 bp, Homo sapiens
gtatcatattttaagagagacattaataagttgattgtgtccatagggaggtgaccagggttgtaaagggtctgatgatgcaagaacaagggagtagcttccctgaaggaacagaaggtatagctggaaagggagtgcagacaaggagggaatgatacaatagctgcctagaaatttctattgagctatgaaaaggaagaggaattagatttattctgtgtagcttcaaagggcaaaaataagaacaaagaggaactttacaggtgacaaatgtttgcttcaatataaggaagaattgtctaataagagttgttctaaagaggaatagactcaagttagtaagatttcctgttcctgtgaatgcccaacagttaaaataaccacctatcccacgtgctgtgaaagggaatcttacattggatttggtctatatgtctaccaagattccttctaaatataggtttagtctcaatagtaataagactctctaacttcatttgtctttttcttcataagtggtttttcatgctctttgaaatacagtggagttcctttgaggtttttgtcaaggaatttcaacgcatatctcttcccctgttgtactgaaggcttttgagattaattcctcatagaacatctaaatggattggagagttggcaagggaaatgaagctcatcccagcaccttccttagtcactcacgcttagcactctgtcaagatctctgcctcatctgctagcataacatgtggattgcttgttggagcttatttccccgccccccatggtaaattctcatttcctgtgtacatgcacctggacttttttgttttttttaccaagagttgggaaaaatcccttctatgctatctatattctgcaaacaaattattattattattattattgagacagagtattattattattattattattattattactgagacaaagtttcgctcttgtcgcccaggctggagtgcaatggcgtgatctcggctcattgcaacctctgcctcccaaatctcctgcctcagcctcctgagtagctgggattacaggcgcctgccaccatgcaccactaatttatgtatttttagta

SEQ ID NO: 9300 - DNA, 1118 bp, Homo sapiens
aggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgagg

SEQ ID NO: 9301 - DNA, 1186 bp, Homo sapiens
actagccgtttgagtcagtacaaaacacttaacttttctgagctttgttttcttcgtcagcaaaattagagccataacagtaacgatttcatagggttgttgagaagactgaatgaaaaaaacgtatttaaagctcttagaatagcctccctggctgtctgaggatagaccgccatcatgaatgacatggtaactatctgaactagaaagttcatgaccaaccaacgacttcagaggaaacaaatggtcattgacgtccttcaccccgggaaggcaacagtaccgtacctaagacagaaattcgggaaaaactagcaaaaatgtacaagaccacactggatgtcatctttgtacttggattcagaactcattttggtggtggcaagacaactggctttggcatgatttatgatttcttggattatgcaaagaaatatgaatccaaacatagacttgtaagacatggtctgtatgagaagaaaaagaactcaagaaagcaacaagagggacacaagaacagaatgaggaaagtcagggggactgcaaaggccaaagttggtgtcgctaaaaagaaatgaggtgtctagcagtgagctgtggagattggatcacagctgaaggggtaaaggtgttgcaatgatgttatctgtggccattgtggatttttcacaggaagatcaataaactaaaaactttcatgtgaaaaaaaagctcttaaaataatgactgatataataaatatgcttaatggatagatgtcagctcttccaataatttattattattttattatagttattatgacaatgtcttgaatccataaagagcaaatctaatctttttttcatatgacagcttcttccctgtttgaaaagtgctaaaatcctcagtcccagaaagtctgcttgtcaatttagttctacagaaatggcaaaaagttgtagatgacagtaagttcaaggcactgaggtaggtttagtatactcaagcccatgtggggaacatatggtaagatatttttaatatctgagtaataatgccttcttcccaggaatttctatccccaaaagagaggtttttaaagagtagaagtaaaataaatctaaaaagaaaatggttgggtttctttgccggttcaaaggtaatccttgctttatgatgcatataaaattttgctttcttgtgt

SEQ ID NO: 9302 - DNA, 1225 bp, Homo sapiens
aggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagg

SEQ ID NO: 9303 - DNA, 1745 bp, Homo sapiens
tcattaagattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttgggg

SEQ ID NO: 9304 - DNA, 1265 bp, Homo sapiens
tacttaggaggttgaggtggatgaaggcttgagcccaggagtttgagaccaacctggacaacatagaaagaacctatctcttaaaaaaaaaaaaaaaagaaagaaagaaaaagaagttgaatgaatgttccaaaaaggaatgctaatatctcctaattggaaattgtctcttagctctctcttagacttggcactttagagtgacattgataaatgcttagcaaagtttctaaatctctgtgctttagtttactcacttgtcaaatggggcttttaacaggacttacctcctagggtggttcctcatgaatctcatgggaagattaagaatggtaatatacataaatcattacaacagtgcccgggcagagtaaatggtcatttttgtagtacaataattgtgtactgttttttttttttataaacctgttgacttctaaagagtaagtgaaaactttaaataagtatctcaaacttttatgtctgttcaagaaagctgccagaaattgaaggagcaagcttaatagtcatgtgtaaccaaagtgcataagtgattttctggtatatctttcttattttcttctactgatattttttttccccacctcacacagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagtaaggttcattttagtcctgccttaggtttagaatgtacgagttcacaccagtaaactgtttaatgtattcaaaaagaaaagctactaggaaacattctttattattgtaactggaactgaacacacaggcttaagttattaatattttactttagccatcaaagttagttttataacgagttgactgtagaaatggatttgacattcattttaaaattaagcactttgcataaatgtatttttcaaaatacagtggatacaaaaatgccattttcccaacactgtagaagagtgactcagtagtctcatgactggttctatagatacaacatgtttcacaaagtagtgccctcttgcatccagtgattgctttgaactcactattttagttcagtaattaatttcagtatttgttttaatttttatatcctaattcttgtttaacttatgcttcacctatccttcctactttgcaaatgaaaa

SEQ ID NO: 9305 - DNA, 1100 bp, Homo sapiens
gtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcaggtaagagtctggtgtagacctgctgggggcagatggctctgtgtatgtgacatttatattagtttttatatctttcagtttgctgttctcagcaatttttagaaacaatgaagtgatcgtgagtagttttttgaataaaataatggataagatctaagtatgattatcttttatcacaaatttagtaaatcaaagttgaaagaaagtgcaatttcaaagcagttttgaatggaatatgtaaagggagtatcctcagttttttcattgaaatttttcaagtaaacattctttaaagatttggtgataattgccctaatttggctgtaatacattttgttgttcttttaaatagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggtttgtatgtacttttaaattctggcttaggctaaaaatcggcagttcttgataccaaataatatatgaagtaactaaacacatattccaaggctgggcacagtggctcacacctgtaatcccaggactttgggaggc

SEQ ID NO: 9306 - DNA, 7275 bp, Homo sapiens
cccttgtgttctgagcattgatgctaattttttggtttgtttccatgttgaccctatgaagatcgaatgggtgatggggtcaggcttgaggggagattgtccttagtaagtacaggctggagggtcactggtgatgccactgtgactgttcatggccatcgtgtgttagcagagaacccaccagtgctgcacctggtagccctacctagtctttttttattgaaccaaacgcaaagccaagggagtgatagttctgctgaagagcactttagggggctcagcgttttgtgtttgtttccctaattctatggtattttttatctgtctggcagagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacggtgtgttgagagctcagattttcagggtgctgtcattgtgaagggaatctttgacttgtttctctaccttgaatgaatattggttaaaggccttgcttttatttatattcagtaatggccttttttcttctttcagacaaacccaccaagtacatttcagactctttttcctgtgtctttttcataggtgggctgttactccagtttgaaaacggagttcagccatggaacctgagagacctcttccgcttatgctggctaaaggatgaaccaccattcttgttgccttctttacctttgtattttcttcagaaactgtactgccactttgcccttttatcagcaatagtctcttgcaattaacttgagagaaaaatttagatttgatgctatttctacctcagtgaaatttctttgaaaggagtttctcacctaatctatcaagatcttggaactgtttaaattaatgttgaagagtaatatttagcagaactcagatgaactcatttcagatagcaccatagtttttggcaggtgacagtttcttatcaccgtttctttcactgggtatcagtggtagctgcaacgccactgatcatttccattcatgatagagaatggtaattatgttccttatatcttctaaaatatttagaagcacctcttcattggcaggagggataattactcaatcttaaaagcgtacagattcaaaggaaaaacagtaatggattttgaaacatttccttgagtaatcctcttcttggaagagatatgaaaatgtattgaatacctttctcgatcattaaaaatagaatagacttcagagggaaatcatatgttagtggagcaataacacttagctttattttaattggttgcgtttcctactgtgaatcaatgacgtagtgtcgtggttttgattagtggagggagttgaaaatctgaccctatcaacaggaagaaaaacttaaaaaatagtaaaagctgcagtaggcagtcccgatttattgactctgtatgttttgtctaaagagaagactccagtgttttcactactcttgattttcaatttggtaccttaattttttggtctattaggatctggtttcatttaaatgtaggtgtccatatgaggctttatggggtatacatgtagcagcagtgacaccataaataatatgttagtaaaaattcttgccagtgctgtggccattgtgctgacagccatgatgagtggtgagcctcctttcccattgctttgactggggactcagtgtttccctgctgctcaaggatgaagctttgtaagattagcataggggtgtggctggagagactcctgcagaacagttctcaggagtctctagtctctgcaccacttcccctgtgagcagggagtttgaaactgcaattgcttctggttggttttatgttgggttgtttcaaggatgctaccaacaacaacatctgttttaacctgctgtcttttcactcactgtcatatggcagcacagattttatagcttgctttctttgttttttttttttttgagatagagtctctctgtcccccaggctggagtgcaatggagccatctcagctcactgcaacttctgccttccaggttgaaagccattcttctgcctcagtctcccaagtagctgggattacaggcatgcaccatcacacctggctaattttgtagtttaagtagagacggggttttaccatgttggtcaggctaatctccaactcctgacctcaagtgatccaccaacctcggcctcccaaagttctgggattacaggtgtgagccaccgtgcctggcctatagctttcaataaaaggtgaatttgcctcttaaaatttgaacagaaagttttaatagtttacaaagtcggtgtcagccagtgaagactaggggcatgaccttcgtatgacttaatgtttttaaaagaaagataaagtttctttgtaaggtattattgtaataatcacatttctttgtaaagtattatattgttcctgagtatctagctactttgctttccagctaggcttctcttgggtattctcttaatcttttatttgtactgggttcttgtgtatatattatagtctgctgtgtgtaatttattataggaaaagggtaagacacatttactttgcggggatgacacaaaaaacctgtaaaaattagagaaacttccagtcatctcacattttctttggaaccgattattcttgtatcttagaactaaaatgacttatactgttttgtttttagaaagggtatccctcctgttgcccaggctggagtgcattggcacagtcatggctcactgcagcctccacctcccaggctcaagtgattctcccacctcagcctcctgagtagttggttactacaggtgcacaccaccatgcctggctaattttttgtattttttgtagagatggggtttcaccatgttgcccaggctggtctgaaactcctgagctcaagtgatctgcccgcctcggcctcccaaagtgctggggttacaggcatgagccaccacatcctatttaaagcttaaataggacttttactatttttaaagtagcatagaaaactgtttgtatcaggcatagtcataattgctctttgatgctgctcctatctgggctgcatgactacatttgtgtgccttgttctcctgtagtgaggacagaatgtgggtcactggaacagtaagtactcatagaactagctgctgctgctattacgactggttgcctgttttgcattttttccgtttaatcatcagactctaaggaagacattattttctctttgtatagatgaggaaacagaattccaaaaagttagctaacatttgcacagagtgtctggctgagcaactaagtggcagagtcagattttaactgacctctggcaagaggactagaggaatacagttgaagtgatacttgctttcatgaacatgaatgtgaaccataatacataatacccatgatgctattttgtggggagtttaaggtgtctcagtccagaaattagcagctgattattgcctgtagctgtaattttacttattcagtgttatttaataaattgccagcattacaatttcgatgaaggcagatttttggcttactgaaacaggataaaaatctggcaacaggggtcccactttgccctgtcatagtaatcgaagctgtgattggatgtggcacagggagtggagtggatgggtgtgcacttgctttccaggctgctgctccccgtctgtcccttattgcatttatcatcttcagcccagtcagtcttgctgttaggggaactgcccagtctctgtaagtgatggcatttgtgaccccattgtaggtaaaaatgttttcccctttttagacattgctggctgagcgcggtggctcatgcctataatcccagcactttgggaggccgaggtgggtggatcgcttaagtcctggagttcaagaccagcctgggcaacgtggggaaaccctgtagccaggcgtggtggcacgtgctacttggtaggggctgaggtgggagtatcacttgagcctgggaggcagaggttgcagtgagccgagattacaccactggcacaccactgtactccatcctgggtgacagagcaggaccctgtcgtaaaaaaaaaaaaaaaaaaaaaaagtaaaagacattgctgagtttcgcacctggacttacagctcagcaggtgggaatccttttgtatttgggccactcatcatcttgctggcgtgtgaggattcacatctccttatcaccttacctgttttcagtttttatttaattttattagttccccacttgacgtccttctctatttttaattcagctatgaattagtattgagaattagaatttttggtgaaaaatttggccgtagttgcagagtcactgtcctctttccttttcacagtgagaactgttgtcttcttcctggcaaccttttataggattctatggccagtgttaatcccataatttgagctcacttattttatatgactgtacatttaacagaagattctaagacaggtttgagggaaatatgttaaaggtgctgtgtactgaattgatcataatgaatgaaatacttttatttcctttccctttgtagctgagatgagtgaactgagtgtggcacagaaaccagaaaaacttttggagcgctgcaagtactggcctgcttgtaaaaatggggatgagtgtgcctaccatcaccccatctcaccctgcaagtgagtaccatccccccatctcaccctgcaagtgagtaccatccccccatctcaccctgcaagtaccatcccccatctcacctggcaagtaccatcccatctcacccagcaagtaccatcccccacatctcaaccctcaagtgagtaccatcccatctcaccctgcaagtaccatcccatttcaccctgcaagtaccatcccccatctcaccctgcaagtaccatctccccatctcaccctgtaactaccatcccatctcaccctgcaagtgagtaccatccctgcatttcaccctgcaagtaccatctcatctcaccctgcaagtaccaccccctcatctcaccctgcaagtatcatcccccatctagccctgtaagtgcgagtaccatcccccatcttaccctgcaagtaccatcacccacttcaccctgcaagtaccatcccccacctcagcctgcaagtaccatcccccacctcagcctgcaagtaccatcccctatctcaccctgcaagtaccatccccatctcaccctgcaagtatcatcccccacctcaccctgcaagtaccatcccccatctcaccctgcaattgagtaccatcccccatctcaccctgcaagtaccatcccccatctcaccctgcaagtgagtaccatcccccatctcaccttgcaagtaccatcccccatctcaccctgcaagtaccatcccccatctcaccctgcaagtatcatctcaccctgcaagtgagtaccatccccccatctcatcctgcaagtaccatcccccatctcaccctgcaagtaccatcccccatctcaccctgcaagtaccatcccccatcttaccctgcaagtgaataccatccccatctcaccctgcaagtgaataccatccccatctcaccctgcaagtgaataccatcccccatctcaccctgcaagtgaataccatccccatctcatcctgcaagtgaataccatccccatctcaccctgcaagtcatagccagctgattttggctttcagtttagtgtctgtatcttacaccttattttgtttttgtttttctgtggacaagtttttagttttataactaaatggagtgacaattaccatggccctctccagagtagcgtatttcttgttcatgtatgtttgttgagaggcaagggtgggggggctttgtttgtgcctcggacctgtgagatactgaaatacctggggttccttaagaattctgtacgtttaagcagatgggtatatggtaactgccccagtttgtatgcattttggccacacgcagtatacacagattttgaggagttgagggaaaagttagttatgggtaatgaaaacattttggacttgggttaaatttttccttacaagctggctggctcaatgtaatgagctttatgagatggctttttggggcttcttttttttgccgggggtaggtcctatggatggaatcttcatttttaattcttttaaggaaatgatgtgggaataatacagctgtacatataaggagagtatgggatgagtctttttgtatcacaaagccttgcatagaggatgtgtttattgtattaatgagttcactgcataaaatatataccttttttattaagtggtgtgatttttatcacaaaagcttgtctttcttggtggcttggcttgagttaaaagcctgtgtttgtgttatcccaagctttggaataaatgattgtgtcctattttgatatatggtcttattttaaaatattctttttgttgctgttttttttgcatttctcaaaacaagtagtgatggggagtgtaaagagcccttatacacagaactaataatgcattgagaagattgaatatgaaatatgctttttttttgttttgtagagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccaggtgagtgagtgactgtgctactacatttgggtaaaaaatataaaatggcattttgtgactgtaaatggaattgaacaaacaaaagatggtttcagaaataattttggcaggatcagttaatccaaccagtctttaaagagcaagtgtgcctatctgtagtattccgaagtattttgactagtgaatatataaaccttaccattctaatttaaaaatggttttcactttcaaaaaaaacatcagtagactgcattaaaaatgggttttccaaacagattggagatcagtcctggtttttattttgttagcagttgcaccaccagcaccaccttccagtagtcagctctgccgttacttccctgcttgt

SEQ ID NO: 9307 - DNA, 1472 bp, Homo sapiens
tcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatatattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaa

SEQ ID NO: 9308 - DNA, 1224 bp, Homo sapiens
ggggtggggggaaaccctttacctaataaaggactgatggaagcacagcaagcggtgggctgctcccggggagcgcgcccagggtggcgtcctgaagggctctcacctcctggccgtaattattagttcaggtttcaccgcctgctataatcagcagaaaccccaggcaacctccaggcaattcactggatgttaaaatgtgcacacctgaaggcaatttaaggtaggtcttatctgaagaggctgctgaaaacttcactgatttccagttctcttcatcttcattaaaatactcctaaataagctacttttgtattttcttaaaattaaatcgctattggggggctatttttagtcttccttggacaataactcaaagttggtcccagagcttgttgacatttctttagtgagcggtatatttgaaatgtaattttcaatcagtgtcttagtacaacttttatggtaaagtcaagagcttcagaaatcattctaggccactgattattgcctcaagcacagcattttttgtcctttacagaggaaaatatattaaaagcaattgagaatgtgtttgtgtggtgctcttggggttttatcaaagattctacgatttgggtttggttacaaaatgttattccctcatgtatgttgcacaggatttaaattgggcatttcaaatacggtaccttggtttgaagtcttgtaggcaagaagccctggtatgtaaattccacaaataaagttgttcttctgttttgcgtctctgtacatctataatatgtaagagggaaaggatgcctaggacaaacagaggtagggcaagatggagtaaagataagaaaagacaaaattgagattgcagagtaaggaatgaggtggtgctctgtattcagttggttttttttgtttgtttttgttttttggacaccagagtgctttttcagattgtatttaatgtattactttgaaaaggtaactgataagtcatttcatttttctcaagctgggactctgtatcgtggtgattagggttacagacctattataatagcccaaattgctgatggaaaaacaaaactaaagtaaacccgtagtaattatttatcttcttagttatcccaagagtagagtttaccccagtgtcttgtctttttccctaatcctttcaagtctcccttcttttccatatgctaggtctcccaaagtaccaggcatagtagc

SEQ ID NO: 9309 - DNA, 3108 bp, Homo sapiens
tgaatacttccagcatatttattcagggtgtaggtgggaataaagtatcttcgcagtgctctgttccctccgtctccccagacatctgacaccctaaaagccatccacagctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacgtcaggtgttcttttagcttccaaactagcatatgtatccattagtctgacagatcgcctgaacaccattaagaggtgtggcgtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattca

SEQ ID NO: 9310 - DNA, 1722 bp, Homo sapiens
caattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgcctgtaatttttaagcccttaggcttagagtttcttttggttttcttcttttttctttccttttctttgctttctttttttcctttttgtttttgtttttgttttttgtttttgtttttttttcgggttattttgttttggttttttgaagcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcagtgaataattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtac

SEQ ID NO: 9311 - DNA, 1242 bp, Homo sapiens
cagagtgagactgtctcaaaaaaaaaaaaaaaaaagccgcatcctgcaaataagatgagaaaggaggtgtgggcgctgggtggggcgggcactcagatgagattctctgcccactctgtagaattactcttcattgtggctctcagaactcggagcctgtgaaaaccatggtttcagggtgaggggtctctaccctaggctgcatttcctgatggcctttaaccttcccaggcctggaggaaatcatgccccgggaaaatatatgttttaacttaaagatgtaacacaattaaaatgtaaacaccagttctcagctttagccctttactgtgagggtgatgtaataagaaaggccactgacattttggggttgatgaaaatggtaacttttaaaggtaacatgggttttattgaaatataattcacataccaaacaattcacctatttaaagtacaattcagcggttttttttcgcagagttgtgcagccatcagcacaagcagttttagaatattttcatcacccagtgcgggggaaaaaccctgtacccttaagccatcacccgtcctcacaccaaatgatgacttattaaatcaagctggcaagtcgtggcctgcaggaaagtgagcaatgattctcagcactctgattagcaagtggctttccagcaagtgtcacagggctgcgggttggggtctgggggatgccagatgcgggatggggggctgatctcactacttggagtatctcagggggctgcctctccggctgcgtgtcctcaggagtttgtttgtttaacaagtcacttggcccacatagaataagctccacttttttggagaaaaaggaaaaatgtgaattttgaagcattcttttatatctcttttatctgaaaatttcttctttctcactcaaccacttttccaaatgctggtcctgatggatggaacaggctccccttttactttatttcataagtggtttataaccctgaggctgagaaacgatataaatgagggggaaagaagtatcctacaagaaatacccagttaaagaaaagaaaactggagaaaccaagcccccatttcttttttttttttctccaatgcctttttgaagcacctaaaggccaaggaattttgaaatgagaactcgacagtgaaatgtttctcattttcaaacaaagaaacatttcttactcttgggtgttttgtgtgcagaaacacttttttgatatgtca

SEQ ID NO: 9312 - DNA, 1210 bp, Homo sapiens
aagaagaagaagaatcattgtttgctcagcagttctgtatgttggctcagcttgaatggctcatctctattccttgtggtgttagctgggctcccttgtatatttggacctcagctgggatgtctgggacagctggggcctgtctctgtggggtctcacatccttcaggaagcgattccaagctttttcacttgatggcagaagggttcccagcaacaagagaaagcaagccccaatacacaatacgcaacagtttctccttgtgtcatatttgctaatgtcctattggctgtagcaagtcaagaggccaagccagattccttttggcggggaccacaggagggtgtgggtacaggaaagcatgattgtcatgggccattgctgcagtagtttataacaaggagtttatctaggatcttgggagaagggaaagcagcatcattctttagagagttgcctgggatagatgcagccagtggttagagagctccactcaccatctgcatgggcccctttagccccacttccctctgtgaccagcagctacacataagcttaagccatctggctcacagattgatgggcactcagtcccacaggagccaccaggagaatatggctggatcagcacaaatctgatgttaatgctagaaaaggaactcagagctggtatgcaatatagcccacgcagatctttcggcagagtgacatctaaaattccctgcagttttctcagcctgccctgagtctgagctgcatattcattctgttcgacagcaattctggggtctgcctgttctttgttcctctaaccgtgctgtggacaacattctgaggacagcaaagccatggaggagagttcggggaagggggagaatcaaagacatgcctacgagactggacacccagattcgttagttgggtttgctgcccttgcctttgatctcctgtgcaagtggaagggtgagctgatggactattgacgcctggcttcatcctcgttgtaacgatcttattttcactgtatatcctttcagggttatgccgacgttaaagattttatttagcaattatttgtgctatctcatcaagatattgctgtgtgatgctgcaccaagagacaataattcaggaaatgattttaagatcagaaaggtgtttggatttagagtctagaatgagtaggagaaggaataaaaaggatcgatgg

SEQ ID NO: 9313 - DNA, 1273 bp, Homo sapiens
gtcaccttgctatatgaatggcgggctgatttttctcatcagcctatctctctgtggtggaattgtgggattgtgttgcttagtgtgggagtcacaaggtggtgttcctgtgtagcaggggttccatagaggcggcagagggaggcaacaggatcagaggggtacagtctgcctttctgttttgggcctcgccagctcatcatttctttgtgatgtctttactaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcaggtaagcctctgtgtctggaacccaaggttttctttttttttttttaatttaaaatttttctctattaaaaatgaatttctattcaccacattgaagtagcagttgtaagtgggttttagtctatttaattcatttagataattttaaagaatttcctttccctaagcctattagttatgtactgtttattagcatttgtactatttgagagtttcccactgatagggtttccataaagataaaacagtggtttacagaattgattagttctcagttaacatccctcagtgtggatgggtcactttggttttagggtcttaacaaaggtcagtattccaaggacagccattaaccgtgaagtatgtgtgtgtatatacactgccaccatgggctagagaaaaatggtgtttctttttttccctgaatatgaactaggagaagggaaatttctccagtgttctggcataagtggacagtgatgaacattgaga

SEQ ID NO: 9314 - DNA, 1205 bp, Homo sapiens
atggcaggggagatggctgggagaaggattaaaaggagcaagagggaacttttggagatgatgatcatggtgatggtttcacaggtgtatatatatgttaaaacctatcaaattgcattctttaaatgtgtgaataatatcccaataaagctgttttaaaaaggtgagtttgctactcgggaggctgaggcaggagaatggcatgaacccgggaggtggagcttgcagtgacctgagattgcgccactacactccagcctgggtgacagagcgagactccgtctcaaaaaaaaaaaaaaaaaaaaggtgagtttaaagtcaactcacctaggctcttcacgcttaggctaaggtatttatattcttcagttggctattcctctattcaaacactaatttaaaaaatatttattgcgtgctgattatgtgctgaacactatgcatggctattaatataaatagagaaccttggagaagggactgggaagtaagtgatgagtttcattttggacatgagtttggggcgtctgatgtgttacctggtagagatgaggagcgggcagctgaaaataccaagacatacttgggaagagaacaaggatggacataatgatttacatgcttcccacagacgggggactgttggagccagaagatttagtaagattattagaggagaacgtggggaacatgtggcatgacacttggtggacacattagtgtgtttattctcactgctgcagaagacctgaaaaaattttcttccttccttcccaataaaacagtgaaatgtttgtactctgaatctggtctcccttgcctcggagagttgttacaactttttgtcctggggctaaatgttgggtttccagatacctagaagtcaaccccaactcagacttttttaggaaactggataaaagtcaaggatgtgaggaaggcagatgctaggaattgagaatacaaaaatggctcagtgtgaatgatgggggattgtgcggggctgctaggcttctctgactctaggagagggaatccctgaagtagaagagacccatgtccactgtcctgtggtataagagaatgtgccaaactctgggatagcttagcatgtggatgctggaaggacttaacatcaaacaccatggccctgggagccacagtcaagcactcctgtggtcccacttggttttgagggaaaagag

SEQ ID NO: 9315 - DNA, 1200 bp, Homo sapiens
agattgtaacagattttccaagagtttgttagcacatctcaaaaaacagagcctggaacagtgctttccagcaggcttccgtcatgaccctggtgaggccccactcactatacctatcttgtcattagtcattgtccctttggttgggctgtgtccttcagtgaatcacaaatgacttgggcagagtgctctaatcaggcattgtggacggtacacagaatggctttacccttcccctcccagggagctcataggctagttgggcagggtggtcatagagtcagatggccacctgatacacctaagcaatgagacagagacatccttcctgggtgagagctgggtgctgagatctgagggaggtgcctacctgagtgagcagagccagaggactttgttgtgcattacagaaaccaatttgtgcccacagaagcccacagatggaaggagtttactgaaaagatgctggggggatgtcatgggatcagaggagttgctgagtagctgagacttgggagcaacgggcccaggccctcttaggggactcagcagcggcccttctccctgggttctgcagctagcatggctctgcagcccaggtgctggccagtccgcatcccagtgacacctcaggcctagatctgccttccatgactcaggactctcccagctccattcccggagaaagagcctgtttccagagaagggaggatggatgtgagcgaggaagtcaccctaaggggtagatactaccaaggggtttcacccataagtgagttgatgtgcgtcttgtcagtctgtaaaaagggttgttgggttattttgatataggagactttatcttaaagtgcttatatcacaacatctatgttgtctactgatatgtgaagcttctggaaaaaaagtagacctttgcttggccttcacaaaattaacattgatggttttgaccttgaggatgacccagagatttgtgccatgaggtagtttgtcgtttcgctgagtttatacgtgcacaggagtgagatgcttaacttgtgaaggagaggctgtccaacggaacagcccgacggttccctcctcaaagcataccccaggctcctacctggacgttccagtggcctgggactacccacctccatactcacttcagtcccacacataccctgtgcctgctgtcttccaggcccctgcgaagag

SEQ ID NO: 9316 - DNA, 1129 bp, Homo sapiens
ggattcccagacccttttttccagcactgatggtttcctaggagtttactttggctctacagccctgggttggatgggtcaggttaatgtatgcaactttgaaggggcccaagacagactcaaccagagaaaaaaatgagatttatttcattactggaatgaagcaattcttcgtacaggtaattatagttcgcagcttttcaggggaaactgggtcaaggttggaaaataaccaagtaaaaagtattttctgacgttatcataagttcagcaaaatagctaaggataatccaaacatgttagtagatttttctaaatgtcctcttatctacttaggagaatggaatgtcgtgacacttgaattggtgccatgccttagcatgagggcccgcctgtttttggtgtccatttaaggtggtaatgatacgagtttttaagttaaaatggcacttaaggtgtcttttttttttttatctttttcatccaaaataggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaaggtagactttctcatacttattttgccttgtttagtagggaacaccgcatagctcttctcttgagaatgagcaatctcagggggctctccctatggccacagttcttgctgtgcgtggccttccatgcatgctttaggctctgctctcccaggagccagctaacaactgcccagtaactgtgaacgtctggagagattggtcagttatgaataaccatgtcttgagcacccgccctgatccaggaccatctggactctagggacacagttgtgagcacaagtctctgccctggaggagctcacaggttgtagggatcagataccaaacatggaaacagaataaatgatacaatttcagacacagaaactgctatgaaaaaatatgatctgtaacttggctgatgggagcgtcttagtccatttgtgctgctaaacaaaataccttagg

SEQ ID NO: 9317 - DNA, 1382 bp, Homo sapiens
aagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtctttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacc

SEQ ID NO: 9318 - DNA, 1127 bp, Homo sapiens
gctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaactgcgaactgtgtaggtttctagcttgcatagctttcaattccttttgctctcaacaagatagacctgccctcagatgtaatttcactgggtctctagtactgtgagagtgaggggccagaaataaccgtagacacatcccacaaccgtcttaccctagttttaagtagtttgagtgttaatagctgacattttaacctattctcttagcctattaacttgtccatgcttgctttttatgcggaaaatttacaccataaggattagtttccttttaaccccaatccaagcctctttaggacttgtataaagaaatacatttttttcaataagatgggaattttagatgacaaccaagatgataccttggttcatgtcaagagcgggacagctgaggaaagtggggtgggatgcaagtacaatttaggaccttggcattgaagccttccccttagtcaacactggcccagaccctggttcttagatgtagcaggagaggctgcctgcttctgccccctttgcttc

SEQ ID NO: 9319 - DNA, 1546 bp, Homo sapiens
cagcttggcgactattttgactgttgcccctgaacacaggaaatactggagaacttactatgggcccagcccaatggcgatatattcccggctccgaggaactgactggaaactcgaggacaagtaggatgcagagctcctgaagcctccatggctgactgtctctctctctctctgacctctccaggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatggactcatagcctgtgtcattcgtaaaagctcaaagacctgagaaaggcttagttcctggggtggggagctgtctgtacctgggggcccactctggacatgtcagcccttgacactagaaagcccagcctctctttccccacttattttatttttattttttggagacagggtctcactctgtttcccaggctggagttcagtggtgcgatcacagatcactgcagcctcgacttcccaggttcaggtgatcctcccacctcagcctcctgagtagctgggatcacaggcgcacactagcatgcccggctaattttgtttgtttgtttttgtagagacgggatctcactgtgttacccag

SEQ ID NO: 9320 - DNA, 2308 bp, Homo sapiens
agctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaagtgcgttctggctttcctcactgcacattgttagcatcgggtgggcccctggggacttggggctccctgcgcccctccttatgcacccctccctctgctccccttcctctgtgcccctgcacccctccctctgcgcccctccacccctccctctgcgcccctccctgtgcccctccctctgcacccctacccctgcgcccctccacccccctgcgcccctccacccccctgcgcccctccaccccccctctgcgcccctccctctgcacccctccctctgcaccgctccctctgtgcccctccctctgcgcccctccacccctccctctgcgcccctccctctgcgcccctccacccctccctctgtgcccctccctctgcacccctccccctgcacccctccctctgcatgccggcgacccttcctccacagttggaatccaccactttccttgccactaggtgggggaag

SEQ ID NO: 9321 - DNA, 1167 bp, Homo sapiens
agtgatgtaggtggattctggcaatatcataaatattagtaaaaatagcatgttcccaatgatgacttacagcactatgccttttaaaaataaagttaaaagcaactacaatgactgtactctctaggaaaatttacaggtgcaataaaactacataaaaaagagcatgggaatgtgtacttctcattccgtttttggtgtcttgggtggcaggaggtggcagtgtgctgggggcgccatctggttggctgtaggttattgtcaaggccctagcctttgtttcagctggtgggtgtgcaggtggttattacattgtgaaaagtgactaagtggaagtgggccatgtgcaaaccaaagatgagtgtcccgagccaaggactgccatgaacaattaacccagttccctgcatgtcaggcccagcgctccccgggccccaagctggtttagctgaggctgtgatggcctggcgttcactgggggagggggtggagtctgcttttccagttactctttcccctgcttctcttgtcaccccctgtccctccagctcaggcctccccacttcaggatgcctgctggctgtagtgacctctgccagcttgcggctttgcacttcctcaactactgtttcctatctgtgtcacacaattattgccttgttatagatggcctcacccactaatcatttccacatgtgcgtgtgtcttttaatgagctggtaatctccacagggccagaggtcatgttttatctcctctaatgtggcagatttctgcccaattctgtaccactctcctcttcttccttacttaaagaacccccagtctcccctcagctaggcagtgccatgtggctgcatggcatgtatggagcagcgtcgtgtgctcctgggaagccttcctagaaggaggaggcagcgcgcctcccttcccccttcctccttcctgctgcacgcactgcagcgtaatggctggaggtccagtccccacagaggggcaaccagacagagactggtccctgacacccagcactggggggctcgtatagcagctttgggctgcctgtctcctgagaaacttcaatcttgtgtaagtcacaatttttaaggtctttgttactcacagatgaacataattctcaggggtgcatcttgtaaccctccccac

SEQ ID NO: 9322 - DNA, 1816 bp, Homo sapiens
atgcctgtaatcccagcactttgggagtccaaggtaggtggatcgcctgaggtcaggagttcaagaccaggctggccaacatgacaaaaccctgtctctagtaaaaatacaaaaattacccaggcgtggtggcgggcgcctgtaatcacagctactcggcaggctgaggcagggagaattgcttgaacctgggaggtggaggttgcagtgagccgagatcgcaccactgcactccagcctgggtgacatagcgagactccgacttggaaaaaaaaaatttttgctttaattctaattaactcaaagttttcccttattgtaaaaaagtatgcatgtttattacaggaaatttagaaaatatgtaaacataatgaattgaagtttaacacagtcccaccacccagaaataaccaccgttactatgttggtaggatctattttctttctccagccagaaaacaccagtgtttttatatgttttattttctgttctttaaataatccttatttcttaacagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaattgtattagttgtatgtttcttgtttttgtttttaacta

SEQ ID NO: 9323 - DNA, 1171 bp, Homo sapiens
gactggctttttttcactcagcataattcccttgagatccatccaaggctttggatgtatcactagtttgttcctttttattgttgagcatatagtgcagatatatcacttagttttaacagctaaggtatctatttaaagataccatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgcctcttggtttttgcctattattatttctctgtgagttgttactccttggtttttatatgctcctaacaaagatactttcactgactatcctacattatttgctgcttgccattgaaatttcatttcagtgtggagaaatgaaatactagtttctaagttaaaaaagacacatggtcctttatttttaagaaatagaatatgtaaaaagttttctcttttaatttgaaaaagagatgcatggttggtatttaagtagtatgtcatcatatttgaaatgccttttgtgacatttttgagtatttccttctctgac

SEQ ID NO: 9324 - DNA, 1985 bp, Homo sapiens
ttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcat

SEQ ID NO: 9325 - DNA, 1108 bp, Homo sapiens
ctcaggcaatctgccagcctgggtctcccaacatgctgggattacaggcatgagccactgcactcggcctgaactttttatagtagtaacgataattcagtaatgtccaataatgactaagtaagttataacaagtacaatgtcagcaataactagtgctttttagtaaacagggtcaggcaaccttgtacccttttaaaaatgttcgaatatcgatatacctccttcctacttggtggaggattgattgaggaggaaagtgtgcagtgatggttaccagcttcagcctcttggcttgactttgcaaatactggtgagaatttggaaagagcttgagaatatcttacatagtcacatgttgctgagaagagttaagaactaacttcttgatgttcatttttaacaatggcttgcattcaaaaccttgtagagctcattagtaggagctaagaagctaatatttgcctttcactaaaattcctgattacttagcctaggtagttcgttgtctctctaggttctgtctttgggagcttgggtctaaggttatcaagctaactctttcttccctctcacccttcccaaattgaccctggtgctgatttgttattcatacgattttctagtttttcttttccctttttgagtatttgaagcttcatactgaatatagtaatcatagtattcatgcataaagaaaatcataaagtaattgcataaatgcataaagtaatcatagttttcatgcattaaaaaaactagttttggctgggcgctatggctcacgcttgtaatcccagcactttcggaggccaaggcaggcgaatcatctgaggtcaggagttcgagactagcctggccaacatggcgaaacctcttctctactaaaaatacaaaaaaattagccgagtatggtggcgggcgcctgtaatcctagctatttggcaggctgaggcaggagaatcacttgaacctgggaggcagaggttgcagtgagccgaggttgtgccattgcactacagcctaggcgacaagagcaagactccatctcaaaaaaaaaaaaaaaaaaaaaaaaactccctattacagattcataatttatgagtca

SEQ ID NO: 9326 - DNA, 1198 bp, Homo sapiens
aatcttcatcaattagattttaaagtattatactacattctgatgccaggcaaacaaagaggcgtattaggcttttaacatctattacatctatgtctatcatcttcttgtttcagatgcaatttatttattttattgagatggagtcttgctctgtcgcccaggctgaagtacagtggcacgatcttggctcactgcaacctccgcctcctgggttcaagcaattctcctgcctcagcctctccagtagctgggataacagacgcgcaccaccacacccggctaatttttgtgcttttagtagaaatggggttttgccatgttggccaggctggtctcgaactcctaatctcaagtgatctgcccacctcagcatcccaaagtgctaggattacaggcatgaaccaccgcacctggcccagatgcaatttaaaagctatttcaaaaaaaaaacaaagcagttgtatttctgataatttttttttcttttagctatcatggtgaacttacttcagattgtgcgggaccactgggttcatgttcttgtccctatgggatttgtcattggatgttatttagacagaaagagtgatgaacggctaactgccttccggaacaagagtatgttatttaaaaggttagtctgcatttttttaaaccagcaattggccaaatttggggaatattctttttgatatgtgccaaaaataaacagaaggggtaatttttcccccttgaggacttagattcaaatgatactgtttttagtcttgtttgttattgaatccttggataaaacagtatgattacctctagaatttaaagtcttcatttaatgaataggctgtttcaggtctttgaaagtatcgtctttttttaattcaaagtgcattttaatatagaaacagtttaaaagtagctggccaaaacctagcttatatacagcttccacatatattgtcatatattatcttacttaagacatgctatagctgagataaatagtaataacagcagctaggtgctgtgttcttagcagcactacctgagagctttagacctggtggtagagtgatagcaactggcagctgcctggtcccattgtgcctctagagatggctcctctggcagcagagagttccagttagcaagacaggatgcctgccagtgggcatacagctgggtaggaggaagcctg

SEQ ID NO: 9327 - DNA, 1083 bp, Homo sapiens
aacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagc

SEQ ID NO: 9328 - DNA, 1298 bp, Homo sapiens
gaaatcaattttttaaggtgagccatttggcttttttaaaaaattgagattcaacttacataccataaagttcactcttctaaagtgtacaattcattggtgttagtatatttacagagttgtacaactattaccactatataatcccagaacactttcatcactccaaaaagaaacaccatacccactaccagtcactcctcatgcccccttcctatgacccctggcagccattaatctactttctgtctccttgaatttggattttctggacacttcataaaaattgaataatacaatatatgaacttttatgtttgacttctttcacttagcataatgttttcagagtgcatcactgttgtaacatgtatcagtaccctttttgtgactgaatattattccaccgaatggatataccacattttacttatccattcaaccgttgatgtacatttgagttgattccaaattttggctattaagaatgctgctctgaacattcatgtgcaagtttttttttttttgtatgtacatatgttttcaattttcttggatatatatctaagaattagaattgctggatcatacagtaattctgcttaaccttttgaggagctgccaggctgttttccaaagtggctacaacattttgcatttccaccagcatgtgtttgagggttccattttctcctcattcttgacaacatttattactccctttttaaattttagtcatcatagtgtgggtgaagaagtgtctcactgaggttttgatttgcatttccttaatgactgatgatgtggagcctctttccatgtgtttattgactttttatatattttggagtaatatctgttcatatcctttgtccattttcaatttgtttatgttcatatcctttgtccattttcaatttgtttatctttactgttgagatgtaagagtttttttatatattttctggatactaaaccattatatattgatttgcaagtattttattccattctgtggcttgtcttttcactttcttcgtagtgtagtttgaagcacaaaagtttttaattttgataaagtccagtttgtttttttcccttcagttctttgtgcttggttttatatctttttttttttttttttttttttttgagatggagtcttgctttgtcacccaggctggagtgcagtggcgcggtctcagctcactgcaacctctgcctcccagattaaagggattctcctgcctcagcctcctgagtactgggattacaggcacccaccaccatgcctggcta

SEQ ID NO: 9329 - DNA, 1170 bp, Homo sapiens
ccctctctgttatcttcaacatactctggtggttaaatgaccttatctttttgacccatttactatgatattttcttaggggctgacaatgtttatctgttcttttttttttttttttttggagacagagtctgactctgtcacccagactggagtatggttgcacagtctagctcactgcagtctctgtcttctgggttcaagtgattctccttcctcagcctcccgagtagctgggattataggtacgtgctaccacgcctagctaagttttgtatttttagtagagatgaggtctctccatgttggccaagctgatctcaaactcctgacctcttgatccaccctcctcggcctcccaaagtgctggaattacaggtgtgagccaccgcgcccagccaatgtttatcagttcttgttgctttgtacttgactctgtgtttcccttctcaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggtaagaaaatgactaatcttttttttgttaaggacactggcattctgaaaacaattccagacactgttaatattaaatagaaaagacttgaaaagccattgacggacctgttaggctggctgtaacataggtgtgttagcgaggatgtggggaaatcagaaccctcatatgttgccaggaggattataagatggtgtagccattttggaaaacagtttggtcattcctcagaagttttgatagggccatcttaatctgatgcaaggtttctgaaccttggcactgttgatagttggggaccaggtcattcttggttgttgggggccgtcttgtgcatttgaggtttagcagcgtccatgacacctacccgttagatgatggcagcatctcctgctccactgtaataacgcagaattctccagacgtcgcccagtgtccccagggagccagatcacccaggctgagacccacttagttcaacatcttcattttagagataaggaaactgaggcctagagagtggaggtgacttgctcaaggtcacatggca

SEQ ID NO: 9330 - DNA, 2638 bp, Homo sapiens
ttctctgtaaatgggacgctgacagcacaccctgcctcatcccaggagcccatcggttctgcctcctcctcctcctccctgcatgatgcgtgcccctggctcacgccccttgtgctgtctctctcccacccccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatcccagtctgcctcaggtacgggtgggggtgtgcagcgtgactcctggctgtgttcctgtaccgtttgtggcctccggggtcttgcgcgtccagggcccagataccgagtaactgccatgtggtgtcgtggtggcgtccataggcctccgtggtggggcgggggcggggctgtgggtgtgcagggcagctgcattttccaagagtggagatggaggatggagatttgcttcgtaaaggcctgggagctacatgggaggtagggaggggccagccacacccagggctggggggccggtggactctgcccagtgaagccaggggagtgtcagcaatgaggggcctggacagcgacgcg

SEQ ID NO: 9331 - DNA, 1178 bp, Homo sapiens
gtgaaaggttgtatgctcacctcagatgtgcattgtgagggagacactaggtaactggtgtacgtgctcagaacagggcccggcttgtcacaactgcttgacaagaggcagccgttgtcatcagacaggctttgacccaaggcctcctgactcctgcgcccgagtcatctgcttccttcctcctcccgggtctttgtggaggatcctttaggatgtcagagggttgagcagcacacaacctcagcggcccccttccctggaccacagtgcgacaagtggtgtcacgctctcagaagttgtgcagtgcacagccagctcgatctcacatggcaggcccggtgaagggaggatctccaaccccgtggcagaagggatgcatccccaggtgttcttcacaagtcccactccactcaccctggctcaaggctcctctaggggagtcctcatgccacaggaccagggatgggccttggtggaggtgctctggacaggtgacacacctgtgtgttggaggctgagaaggtggtggattctgacagagcttttgaccccttgtcttcccagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcaggtaactgctcttctcaccatcttgggctgagcaagactcaggggcccagctgggatgtggcagcagctgtctgtccttcggcactgccccaaccaccctgtgttcttggtgggatggagaggtgctctaaaggtggaaacagttgtgtacggtggataaagaggtcttggggaactagtaaaatgtccctattccctgggtcattgtagggggccccacccacctgaaccaccgtagactccaggatgcatccagaagtgttctgtccccagcatgcttctgggggacccacacaataatgatattcatggaggaacacgctgggacaggtgtggccagcatggcgtggattggccttccagggaagccagggcaggtgctgcctgctgtctcccgctgagccatctttaccttgggtctcattttcccctggggagcctgagacaga

SEQ ID NO: 9332 - DNA, 1133 bp, Homo sapiens
ggcctatggtctcccgggtggcatttgggagcacccagagggtgagccaggcgctttctaagctgtaaaagtgccctgtgatgtgagcagttatgtgatgtgctctcccagcagcacccagttttggaggctcaggaagcattcccagcagggcctgtttttagccttgaaacatcatgcttgaaaaatgcttgcatggggtttatttaactttaagtggggcaaattctgaaatgggttgtttattgtccaagttgaatttttaatttctcataaattccccacaaattgctatagtacatctttatttgttgaatctgtcagagttgtttatggcactgaagcctgggctccccctgtttgtggactgttgccatggcaacaccaggctctggaggaggggcactgctctgaggtggtatagaaggttctggaatgggctggtggtgtgaagtagagctgtggctgctgcactgagacccagccgtgggtggactgagctgcttaagaccctggttcctcttcaacatcactgcacccctcttggtccctcttcccttgggggtgcactgctgaggtctcctaattctgcttccctaagcccttgctgctcccagtgtggtctgggaaccagtggcagctgcactgatggggcgcccatgaaaaatgcagactcccttgcccccagacctgctgagtcagtctgcagttcaccaagctttcaggcaccttctcagcatgggtaagctgcagaagccctcacatgccacactgcccttgggtgaccccagaggccttggcctggcggttcttggtgtttgccaccgtcctccctgtgatctttctgactccttccccgacagttccctctgcttggccaggagtgggctttgcctctcaaccctgctgcacccaggccactctcctgctttgcacacaccagtctctactcacacagtcaccccagccttctctatctggggaactctggacatcttggaagaggcaactcttgagacacctcctctgtgaagccctccctcctttccccagaccgggtgatgttcagtttcactggagctctcctgtggcctaaacacctcacctgccccagcctcatcaggctgcctgat

SEQ ID NO: 9333 - DNA, 2682 bp, Homo sapiens
ctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttctccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaatagttgcttttcagattgtttttagtatatttaagtctacacagcctccctctgcaggttttaagaaaatgcaggcagggcgcggtggctcacgcctgtaatcccagcactttgagaggccgaggcaggcagatcacgaggtcaggagatcgagaccatcctggctaacatggtgaaaccccatctctaataaaaatacaaagaattagctgggtgtggtggcgggcgactgtagtcccagctactcgggaggctgaggcaggagaatggcgtgaacccgggaggcagagcttgcagtgagccgagatcacgccactgccctccagcctgggcgacagagcgagactgtctcaaaaaaaaaaaaaaaagaaaaaatgcatagagccgggcatggaggttcacgcctgtagtcccagctacttgggaggctgatgcaggag

SEQ ID NO: 9334 - DNA, 2704 bp, Homo sapiens
ccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaatctgctgagttggatacagtctgttttagcagtggagcatacagtcttcaattatagaagtcat

SEQ ID NO: 9335 - DNA, 1965 bp, Homo sapiens
catgaaaaatatcatgtgttgcaatattataaggtcagcatagaccaatgttttccagaggatctgtgccaccaaaaaatcacaaaaatagagacagagaagagcatactgtactggactgagaaaccgagggcgtcccaataattcacgggctccattctgcccaagtcgacatcactgccccgtcatcacaggctttcagtctgttacagtggcaaaagcaattcagcctttttgatggtgcagagcttcaaccatttcaacaaataaaggggcagggtgtcatgttctggaaaagaagcatgcagctagatttaggcatttttgctcctcagaactacaaaaatgagtctgcacacaaccatccttccaaacttgactcatctttgcaaagtctccttttaagtacaaaaaaaatggcattgcccattaattttgaaaagatagcctttccgcgctacctacagaggggtccatacagcgtcgttctggattcccgtcgtaacttaaagggaaactttcacaatgtctggagcgcttgatgtcctgcaaatgaaggaggaggatgtccttaagttccttgtagcaggaacccacttaggtggcaccaatcttgacttccagatggaacagtacatctataaaaggaaaagtgatggcatctatatcataaatctgaagaggacctgggagaagcttctgctggcagctcgtgctattattgctattgaaaaccctgctgatgtcagtgttatatcctccaggaatactggccagagggctgtgctgaagtttgctgctgccactgaagccactccaattgctggtcacttcactcctggaaccttcactaaccagatccaggcagacttctgggagccaaggcttcttgtggttactgaccccagggctgaccaccagcctctcacggaggcatcttatgttaacctacctaccattgctctgtgtaacacagattctcctctgcgctatgtggacattgccattccatgcaacaaccagggagctcgctcagtgggtttgatgtggtggacgctggctcgggaagttctgcgcatgcgtggcaccatttctcgtgaacacctatgggaggtcatgcctgatctctacttctacagagatcctgaagagattgaaaaagaagagcaggctgctactgaaaaggcagtgaccaaggaggaatttcagggtgaatggactgctccagctcctgagttcactgctactaagcctgaggttgcagactggtctgaaggtgtacaggtgccctctgtgcctattcagtagttccctactgaagacaggagtgctcagcctgccatggaagactggtctgcagctcccactgctcaggccactgaatgggtaggagcaaccactgactggtcttaagctgttcttgcataggctcttaagcaacacggaaaaatgattggcggaaaataaacatcagtttcttaaaaaaaaaaaaaaaagaaaagaaaagataacaatgtccttctttgcaaggcttctgtgaattcagtcctttctcccagtttcacaggcaaataaggacagggactcagttgaggtgactaatcctcggagccacagccccccaattccaggggcttggaaatgctgggatcacaattaaaggctttgaacttccaccagacaccaccaccagagctcactccatccgcaaatgctatgtacattcttggccacaaaaacacttccaggacaaaaaaatgtttcagagttcagaactattcaatcccacatttgttctctatgaacaaacgatgcaggaagaaatggaagaagctgaatctctctgagggcacactttattttgccctgatgagaacttagtagcacctaagtgcttcccaatctgacaaggccatgctacacactccaaggactattgctgaagttggctgttcacctgcaaaa

SEQ ID NO: 9336 - DNA, 1714 bp, Homo sapiens
tggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttcactttgtgtcctttcatcttttttcaattcaagtgggtaataacgtttaaatagtggtagcagaaatgatctttataatgtttcaattccatggtgaatcatatgaaaatgcat

SEQ ID NO: 9337 - DNA, 1119 bp, Homo sapiens
tattcttaattgcaaaggtaatgcttttctacatctggaatttcgttttattagtttgaaaatctttttgaaaatcaaattaccacattttcaaattttgtcagcaaaattgaagatctgtgtgatcagcatatgagtgctttcattgtgtgtcctaccagagttagacgacttagttgaagttttgcattgtggacattaattttaactttatatccatgttcaaagtccttaacttaaagcttcatactggataaaggtcattttataacttagaaaacgaacattcaaagaacatgttttactttgtttatatgattaaataacttattttatgttaattgaaaacaaatggccatgattttaaagttgccttttagtatttgtggttgtcatttgaaattatccataacccttgcttttattgagtttcaaacccttttaaaaacagcagctatgtttcccctccttccccattccccctcgtttcagacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaac

SEQ ID NO: 9338 - DNA, 1212 bp, Homo sapiens
taaaactcatttaccctttcaggcctcccacttctgattaattttctcatttaaaatacttttattcttaatagtccttttcttttctaacatctgctgggtaattggatttgatagttgtatttgtgaagtttcttttttccccctctgaaaacctcactgttccttaatattcacttggatgtgtctgtcctagtgagctgggtaggaacctagattagtttgaaaatgttcagccatgaactggcagaaccacgattactctaagtttagtcattcatgttattctaaagaagtattctgtgtatacaaaaataatgcttaaagaaagggtaaatgccatttcaacacgtatttacacaatacagctgtatatagcaggcattttattcctctgagttattctcgtataaagacgtagactgtggggttttttttgtaaatttattggaggacgattttagagaatagtgaaatttcctgatttaaaataaaatccaattttataaattttgtacttaggtaagaagtgcataacttttttttcaccatgtttctaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctggtaataaaaaattattttatcaagttgtgcaggggaaattggatgggattttatgtttaaacagattttctgtgtttcttaagttaaattattgaagaaagtttgacagataatgtactcatttaatctcttctggcagaaattgttttgtcctatttctttttgctgtttctcttaaatgttctgcttctgtatttcttttgaatggattgcttttggaacataagtattggaacatatgtacattagaacataatctaagttgttacatttatttttttcttgatgttttagcttcaccaagtatgtcaaaaggtgcttaattatggataattaacgtttgtacttatgattttgctaatcagttgtattaataaagttacatgctgcttagaaattagatattcagttaagagtttaaaatactgatttttatatgcttggattatatataaaaataaaaaatataaaatgtgaacctaagctggt

SEQ ID NO: 9339 - DNA, 1120 bp, Homo sapiens
tgagagctgatggttttataaaagggaattcccctgcacacgttctcttgcctgtcgccatgtgagacgtgtcttgcttccccttcgccctccaccatgattgtgaggcctctccaaccatgtggaactgtgtgtccattaatcccctttccttttataaattactcagtctcaggtagtatctttgcagcaacatgagaacggactaatacacctacatcataggtttattgtgagaataaactgagttaatatttgtaagaagtttagaatagaggctgcatatggtaagtgctgtgtatgtgttaattaaatacacttttgcatgctgagtgtccctgagaatggcagggtaagtaagaaaaacaggctcatgcaaacacacacacacacacacacacacacacacacacacacacacacagagagagagagagaaccagaaaataacatatgttatcctccctggacacctcgctttaagttcataaattgcttccctccaggtaaaactggttagcattgatgcagcagaaatagcagatggcaacccttctttggttcttgggctgatatggaacataatcctcttcttccaggtaagatcatttcttttccaaaacacacaatcatgatcttgtgtctgctgagcagccacagaagagagtggggccagattaagggaggcagtgaggcttagtttatggcagattttatcttttctactcactgaaaaagcactagaagaatctggttgctaaagtgtttgagtctctgtgattttaaaagcggtgcaagttctctagaagagaatatctatcctcttgggtctggaagagttaaatatttacttcaaaaaataactttgttctaaagtgtcacaagaaccggggaatactcctgaccaaaactggaacttggtagagttactttcctgaaatcactcagtgttccttagaggtgattaaagagcttgcactaaagatgcctgaggaagaagaataacaggcgagaccttattgttctgttctttgcaacttcagcctctaactggaaatgcagatttgatagagggagaactggatctgtgattggaataagaagatgacattttattttt

SEQ ID NO: 9340 - DNA, 1231 bp, Homo sapiens
cccaggctggtctcgaactcctggcttcaagggatcctcctgcctcggcctcttaaagtgctgggattacaggcgtgagccaccgcccccggccgcctctgagtttccagcctcgttggccctccagccttttaacctgttgggcctaggatcaggaaaggtttgttgaatggggaactaagaagtgaattcgttcgttcgacaaacgtttcctgagcagccgctgggtgctaggcgcagtgccagcgcggaatgtccagggagacctggtgcccaaagcttggacccatcgtgagaaatgagaagcagatacaaagcagtgtgggagtgcagaggagacaaagcaagcctcatcaggcccattgcttgctctgctctcccttgtacttaccagtgcttgacaatatacagttatttactagcttggttattgacttcctacccagcactcagttttattcactgctgtatcctcagtgcctaggacgatgcttggaacgtggtaagtgctcctattggcgggaagaataaatccggaagagcaggaccagtggacttgctacataatctgtagtcttggagccgcacagggttggtggtaccctcgagcacaccagacttgcagaaaaagcatactccagaggaagctgaggcatgcctgctcgagagccagctgttccatgtgcaattttcctctgatagtttctggtcactgttgccacggtgataatgactgggctatgtcattatctatccgccaacagtaagagaagctttgcagtcgagatattgtttagcagatggagtgttttctgttgaacactaagtactgccacaagttacttttttttttttaaactttgagtatttttttacaatgttgctggaggtgatctgtttatgctttgagagtgttcgaatttaaaatcagaaaatcatgtcagtgagtgagtctttcaaataatccttcggcatgaaacctgagcctagtaaactatgaaagtaaactcggcacattacccgaaagtctcaatgtcatattttcacccccatcaatattattgatgattgctcattttctaatgtgggacctgaaatttaccaggtgcttaaagaatctttttgtttttcagattcattgattccaggtaaatcagaggaacaagcaacatgaacagaaatatgtagaaaaagctattatgcagaagcataattgttgtttcagaagtcc

SEQ ID NO: 9341 - DNA, 1231 bp, Homo sapiens; identical to SEQ ID NO: 9340

SEQ ID NO: 9342 - DNA, 1362 bp, Homo sapiens
gagtcagggcctaaccactggtctctttgacacaaaaactcatgctcttagtggcaagcacagtgttctcaagattgggggaagccagggagggacagtgggttgtctgctactagtgggtcaaaattacatatttagtcatgaatggttcagcttttaccatttaaataacaaataaatgttctttctccataggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgccgtcgagccctggtctactttctgggggaagcagctgtttggatggtgagtcaactgtgcagctggaggcgtgggtgggctggagggagcagaggtgggtgaggccggaggaggcggccccacctgcctatctctggagccctgtgcttggcacactgctacagttagatagggagacatcgtcaacagtccaccgagctaggggatttaatgagtattttacttcttaaaaagtggggactttctaaaagaggacataatttggaattgtggcagagattctcccagtgtctggtgtctttataagacctttccatgagttctgcatcccgagactggggcctggtagagcctggggctgtgcagaggcccatgggaaggaagcccgcctggtg

SEQ ID NO: 9343 - DNA, 1108 bp, Homo sapiens
tttttttttttttttttttagtagagacggggtttcaccgtgttagccaggatggtctcgatctcctgacctcatgatctgcccgcctcggcctcccaaagtgctgggattacaggcatgagccaccacgtccggccttaccattgctttattaaataagcactggtgcttgattatatcagctgagccagatattagatacgctattgagttttgaggaaataagagtacaaaactcagaaatgagttgaagtatagtgacatcttcagattacagacccaggtgtcagaatttgccttggctcagaaggcctctgggggccatccctgaccactaggcttcccacttagacctgctccagcagcaccacccctcgccactgcctggtcctttccttcacccttgattctgtcttcttttgtccttctccaggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgag

SEQ ID NO: 9344 - DNA, 1192 bp, Homo sapiens
agggttctcaatttgatttaacgaagtataattagggtcatctctcatatttcatatactatgctaggtactaaaagtacgattacatattagttagaaactttttggttgaaatggacacaaaacatactggcttatatggaaaaaaaaaggtaataacgtcgggtaatttactaggtcaagaaccaaacttgtaggattccagctgggagtcaggttcaattggaaagagaacctgcaacaccctcaaatctttattttttctactttattcctttattccaaaatgacttttacccagaaggtgtgtggcagacagagtttcaggtgccccccaattatcccagcctcttagcactcacaaccttatacaattccctatccttaagtatgggcatgacttgagagttacctctcaccaataaatatggcaaaggtaaaatgacgtcacttctgtgattacgttacctaagactgtaacatgtttcttgctaacgtgttttttcttgctggcttggatgaagccagtgggcctgttggggaggccccagtgacaaggaactaggggcagcagcctctagccaacagtcatgtaggaactgaaggtagcctctggccaacaccagccaacaacaaactcagaccttcgggcccatgggcaacagcatccggttctgtcaacagccgtgtgaacttggaaagggatccttccccagctgagccttgagatgagacaggggcatcagttcccaccttgattacagctttcataagaggccctgctgcagaggatccagcaaagctgtactcagatttgtgacccacagaaactgtgagatagcaaatgtatgttttttaagccactgagtttgtggtaatttgttatataatagataaataacatgaagggcatggccactaaaatccctgcacctgaatctcaagctttggaacctgggcagagctgaaaacaagtttttctcctttcctgttgaaaattcctaatgaagagctttgatcatcccagcttgtgtcaggtatccacactactaaccactgaggccagggaggtggaaattggcaggaggcagcagcctttattcaggctgattgaattggatagaacatttcccatgacaagagaaaaagtgcaattatggtcaggccaaacagtagttgcccaccgcaaatg

SEQ ID NO: 9345 - DNA, 1410 bp, Homo sapiens
aaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtgatattgttttatgcttccatgaatattttgcttttcttagagcatattcatagatgcagtactgtgatttaccacaagataattgggaacactttctcaaaatcgattttggttaatatcaggtaaatcattacctaggagtaagagggaaattgttgtcaattcctgactttagattgatccagcagaaagaaaaggtggaactttgtatatatccactgttgaaagttgcatgacctgacttcctgttttctaaagttgggggaatattattgaacttcaatttcagaactgcatttcaatttggggcttggaaaatgtagttaaatcaatttcgttctctaaattttctaagcaggaaagcaatgtaaaccaaaaatcaaaatgtttagaatttataaaaatggggttatatagcttttaattttagtttcctttttactgccaaaaaacttaaaaagacaacagcgtaaccacctgtttaagcaccgtgggaccatctcttattcggg

SEQ ID NO: 9346 - DNA, 1199 bp, Homo sapiens
ccccagtgtggcgtcacttccgccagcgcccggcggcgcgccgggagtctgggtctcgtgaacgcgccaggagcgtccctacagccgggaacgcgcctcgcggatgacaacaaattcgtcgcgcggcggcagtggcggtggctgcctcagcccctgccgcctcctctcgcgctctcttgcactctctccgagccggttgggaccctcctcggaagtcccctggcctggggccaggaggacccctctgcgtcttgcctccgccaggcccagcgcgagcggtgcggcgccggcgatggggtctccctgagggactcccggcaccaaatagggatggaggggccgccccaggcttaggccccgccgcggcctggagccggagtcgctaccccgaggccggagccgtcgcaacccgcagccgcagtcagcccagctgccagcagtcactatgccttggccgttttcggagtccatcaagaagagggcctgccggtacctcctgcagaggtacctgggccactttctgcaggagaagctgagcctggagcagctcagcctggacctgtaccaaggcaccgggtccctcgcccaggtccccttggacaaatgggtaagagctgccggcggcgagccgggcggggctcgctcccctctttagggcgctttgaaccagtgccatccaagattggtgacagtcagtccctccttgggaattgtttggacccgagtgtgacacggctcagagaaatgtgttagagtgttgtttaatctgtttctaacaagtttgctctcctaaatcacgtgttccggaaactttaacagatgtaatggaatctacactgtgggaataattgagtcagtgcttcgggggtctgtgaagcaggctcaataggtccgtgggaggaggtgaccagaactgtccctcgggatgtgaggggccgcagggttttgtggcaaacaaaccctgccttgtgggatgacattctggaaggattaaggatgaagaggacctttggatgtcagaatccctagttatttgttttgggttggctgcttgcgcaccatgtttgccttgtttgtcatcgtgcagcgtttgccatctggaagaaagttaggtgaaggcctcttgtgccggtttgcctgcttttgcttgattatatgtttacaagataggtttgtgtatccagcctgtgaatggtcgt

SEQ ID NO: 9347 - DNA, 1171 bp, Homo sapiens
tttttgctatttgcttcattatctatgaacttcgttcattgtaagccagatgccaggtttcatttggggaatgtcttatattggtaaagtagcatttctgtagcgtgtttatcaatgtttaagaaacagattttggcttcttttcaagaggtgaaatttctcagaagtttactatattctgaattagtgttttctctagcaatgtatttggtctggattctaacttagatgtttaagtagtgacagttaaaatccttggggcaggattttctctttggtcacttgcttttggtcactttttgtcaaaaattttgggggtattgcagggaaccaatcatgtttagaaatgtgtgttactaaattagtttttctggtcttactgatttgtttcaaattgtagaattcttttggcagtaattgtatccaattttgtttatagtccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggtaaatagatattctatatttttttaactcggaaacttttattaatgttgacataaactaattttgaggcattctctacttacttagaagaccagggttatttgcccagatctatatatctgttttggagaagagggatacttaagagagaaaactttttgtttttgagacggagtcttgctcgttacccaggctggagtgcaatggtgtgatcttggctcaccacagcctccgcctcctgggttcaagcgattctcctgcctcagcctctcgagtagctgggattataggtacccgccaccacgcccggctaattttttgtatttttagtagaggtggggtttcaccatgttgggcaggctggtctcgaactcctgagccttggtctcccaaagtgttgggattacaggcgtgagccaccgtacctggctgaaaacttttattttctacatagagttctcttcccttaattttgatgttatttatttttttttctgaagaattaattttgattttttatgcttttggttattatagtactgaattgtctggagaaaa

SEQ ID NO: 9348 - DNA, 1101 bp, Homo sapiens
atcaagcactgaattaatgacaaatattttaccattgtctacttctttggattcttctgcttgaagtttattttgtaggtcccatttaggggcctggtagagaacctataagcaccaaatacgtagtacatagaggaaaactatttttgttttaccaatgaacatggctatgactaatgacatcaagatgttgggtgtatgtttgaataattccctctccaccatgaaagtacttgctgagccatctttctttgggctcccagtttacttgggccactataaatagaggatgctgcaggatcaaaatataccacatcaattaaaatcatgtttgtcctccattgactggtaattttaagtaaggggtggaacatttttagaagctcaccagtatgttaaacagattctcaacatcaaatactaccatgataggatgcaaaataattttcttgtaatattaattagtggttgatgggcttaattttttttaggtgctgatattgatgcgttgtgtgttgcaccaagacatgttgatcgaagtgactttttcacctcattctatgataagttgaaattacaggaagaagtaaaagatttaagagtgcgtaaatgttcggggtgaaatgggatgagttatgaacattcatttagtcagttgagtgaattttatgatatagccatcatttattgagttcttgcaatttgccaaacctttctaaacacttggcatatgtgtttgtgttttattctttacagcaagcctaaaattataaactcatttacagattaggaaattgaggcaaacaaaataaatatgaaataatctggccacaatcatacatctgatgagtgggtgaagtaaaatatttgaaccttgatttctgatctgtctgatcgaacagcccagtcttaaagctagctatttttgtgtcaggtgttttgctaaagtactaaaactagtagaggcttaaaatgtagtttcagagaccctgaacttgtttactttccttataggctgttgaagaggcattcgtaccagttattaaactctgttttgatgggatagaggtaaggtatagttcaaattgacagttcttgcta

SEQ ID NO: 9349 - DNA, 1094 bp, Homo sapiens
ttttttcattgatttgtgaaccttcattttgttgaataatttttttcttgaatcctttcacatgaatgaaccctaacatctagctcaaattctgacacaaagtagatatattctttaatagatgataaaactggttaatgtctacaaagtaactgagataacaactgctgctgtactgatatgatactatgtactatgatgatattttgctgctcctgtgcagctccgagttattttaacgtgatcatttaaacatgtgcttttgctagatgttaacttttattgactctaaagatatataaatattatgtttagtttctgaaataccttttccataatctaataaaactttagggggagtaactaacatcaggaagtatgcttaatattgatacgtggacaaacttgtttatcagtcttaaactgtcctgtgattgtgattgcatgttttttggtttgccacatactctcgggacttattttcatagttttgtcttactgaatttatccctatagtaattagtacccatgggtatttgccttttagatatttttatgagtgagtagaattttctttctaatgaaaggattcatagagccatagagagaaaaatcacccagttatgtaagaagaatgattatgttgatttaaaaaaaaattcattcctatctttggtaatgttaggggcgtacttatttctggggaggtgataatattgtggctatacctaataaagagttcttattgttttgagataaatctggaaatatttatagatgaaatgataagatctctaggatttgcttcagaataacacaaggtgaattgaaagtgggaggacagtggctttgatttgataattgatgaagctgggtaatgaatacatggggatgcattatacagtgctctctactttgtgtatgtttggaattttccataataaaacttttaaagatccatctctgtatttttttagtgttaaagaacgcttgtgatttaatctaattaatatgaaaataatctacctaaaatttaggatgattaaattattgcttagctgtatatatttgtttaatttacagtgtcagaaaat

SEQ ID NO: 9350 - DNA, 2741 bp, Homo sapiens
aatacttttcttcttagaaggtttcttaggaagtaaagcaatggaaaatacatctcattgttaaattatggtgctttgaacaatgttgtgttctttgctttcattctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaaacagcacaatctcacagttgcctgatttcttttgactactacttttttccagtaatcataagtttatagtatgattctaagtgaggatttgcaaaagaatttggttacattagaaaagatttgtttctggttaacttcagccattggcagcagccttgtatttatagctcagataataattaggtgtttgtttttcatataattgatctttagggaggaaaacattaatatagttactattaattcaattttagctcttccgtcctctaaagtgttctgtgtctgtagacaccatacgttatctgtatatttattctatgcctgtggacagtgtactgtccttttcaaagcatttagcactttaatgtcagcaggtggcactgttgtttttcagtgaatttagaattacagaccacaaccaacaggattctatgtttcttattttactaaatgcaaatcagatattgcttttcttaacccccc

SEQ ID NO: 9351 - DNA, 1207 bp, Homo sapiens
tacaatgaaaggcatacttctgaagcgtacgttttgatgtgagtgtctggtcatgcgaccacctgcccagtcaagtgttagaacctcccgtcaccccaaaaagttccctcatgtccccatccccagccgttgtgccctctgtctctatagttttgctggtttagacttcttgtaattaattttgctcttgttttccaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaat

SEQ ID NO: 9352 - DNA, 1687 bp, Homo sapiens
taaagataagtatgtagaggaaggaatgttactctggcttcaaaactcagtagtagtagtaattcacatcgacagattagggtttttgttggaggcaggaattttgttttgatttggtctggttttagaacttaaaagtacagtaaagtatacagtaaacgcctttatgctctactccaaatgttatatttgcttcaggttaaagttgaaagtcccttttttgattatttgcttctcagcatatgtagtttttagtttttctgttggaaacaggattttaagctatacttctactcatttaactataagataaatgcttacattttaaaatgtatttgaatatttatttgaagtgctgatatgcagccttaagttgtacttcatgtgtgattggatttctgaccgtagatatggttggattgaagactgtaccgtgttttgatgattctcctattattatttttttccctaggcagaagaattgtttttatgggttccacgaaaattgctaatgactgttgaatctgctaaaaattcagtgttgggtgagaataatttctgactcttcaaggcaaagcacaaatgacaaaaatatgtaaaattccattttatggcactaaggataatacttggtttttctcgactggcgaaatattccctcaaatatgcattaagtgtttttcatttaatgttataaaaaagatgcacatgacctttatttattattattattatttttgagatagggtctcgctttgtcacctaggctggagtacactggcaccatcatagctcactacagccttgatctcccaggctcaaatgattctcccacaggtgtgcaccactacatctggctaattttttttttttttttttttttgtagtgatggggttttgctatattgcccaggctggtctcaaagtcctgagctcaagcaatcctcccaccttgacctcccaaagtgctaggattacaggtgtgagccactgcgcccagcctgtacctgactttaaatgttacaagaccttttagtttttctgtaatttgtaaacgtatatttaaatgaagtttttaagaagtttgtggaacttacgctgttaacttctgggttaattcagggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccaggtgagcagctgtttgcaatttaagtatatatttcacagagtggggaggaaagaggaattgagtccataaatattccatttgatgtcttattaaggatacttaaacattttactttttaaattgaaaatataaaatacatttcatcgtttgtttttacagaaatatcaatgaaatgcggttacatatatatatctgatttcatcagtgcccagtgttaatacaagcagcagttgttcctgagttattgaaatcaccaagtttttttgtaaacaaaagatcacaatgaaattttaaaagccttaaagcat

SEQ ID NO: 9353 - DNA, 5488 bp, Homo sapiens
gttatggttaatgggaaatgattattttaaggcaaagtggggagagaatatataggtctttatgcccatatgtgtatgatgtatgcatgggttttatctctctagtatcctggaatatgttagtctgcacagtgaaatctatgtaattaaaaaaaaatctagagtaaaatttgctctactatagtttttgtaggtgaaaaagaacgaacttttcttccagagactacaaagcagatttttttttttcccatttgagaacctctagatactaatactacacatttctttttctggaagaaaacttcatgtaaggtaagatcttagcctctgaagactaagacactgccatgtgttggacatgttttattacttgattttgttctttggtaatgtaatttttttctcttttctttctcttctctgtagtcagaaaaatgggtaagaagagtcgagtaaaaactcagaaatctggcactggtgctacagcaactgtgtcaccaaaggaaatcttgaacctgaccagtgagctgctgcagagtaagtcctcctctgggctctccctgccttgatgtggtggctgtgcctttttcttctttgtcaccagaatggggacgcgtgcatcagacaagctggtattcaggtccaagcttattagctgtgggcctgggcgagtcacagaggttcccaggcttgcagtcctcacctgtgaggatggaaacacccgtcagaactgtgtggctgttaacaaggcttgggtgaagtaattgtgagcttccatggcacagtcacctggaacatggtcttccctgaggacctgtgggcgagaagaagctctactgctttttcacagtgtgccgctcggcagattactgaacccttccgaaactcagtgttcttgtcgtaaacatagataataactgtctcagggaatgagccaagggccttgtgagatgtggtgtgtgaaggtacttcacgggctgttggcccaggggagtccagcgtgcctcttggagacctggccttcagagctctgcccctcactggaatggctcgcctttctttttggtgattcaattaacagtgcttctgattttttttcttttttaaacagggtcccgctctctcacccaggctggagtgccatggcactatgacgactcactgcagccttgacctcctgggctcaagtgatcttcccacttcattctcctgagtagctgggactacaggcctgtgtcaccacgcccagctaatttttttgtagaggtgaggttttgccatgttgcccaggctggtcttgaactcttgggctcgagagatcctcccacctctgcctaccaaagtgctgggattataggcgtgagccactgcacctggctgtgtatctgatttttacatgctgtagtttgagagttcttagtttaaggaagtgaaatatctattaagtgcctctacttgttttagcaagttagtgtaatttggtaactttttaaaattatgaatttgaattggtgcaattagtgccttggctgtagctgtggtcactccgttgccctttgtccatgtttagattatgtggcaggctaaacctcaagtaaaaatgcagctttccctttgagacagaaagcaggccgcagccaagttggagtcaggtccctctcgagtgctgccctggaccctactggccggtggagtgtggctgtcctgcccattcctcgctgagctcccctgcctctggcagcttgaggacaggctcgctgctgcttcatctttgaggcctgttccaggcctcagtgagtgcttattgttggagaatgaagtaagactggctacccttcatagttaagactcagcgtgtgtctagttattgttagttatttgccacatatactcttttaatagagagcaaaggggccccaaaggttaagcaggagtgtgggaaggggctgtctaaaccaatgcagttgtgtgaaaagaaagagctgccaataggcggggtgcccagtgtgcagtctttcaaactcacacctcagcctcgggtgttggtcttttggttctggccccacagtggaatcttggcttcttttttagcagtgactatgccatctcattttgcaactcccccagactgctgaatatagtgccgtacacatggatgtgaaatgtttgtcgactaattgtccttatgtccaatttaactggttcccttagggaatcagtgttatggggtttaactaaaaagaaaggttgacttttactattaacttttactattaacttctttttgccatatagaagagttttggggggatagtttgcattttagcttagctttttatcatagattttcctgttagtaagtatattctaaaaagagttaactaagaataaggtggatgtgagctaggtgcttgctcagtgctctctcttgggtacgttaagtgggggatgtttttatgatgccccagggtttgtctgctttgagaagtgtacctgccttgtacttctcacattcattatcatggctgtcatatgtctgtcttttaaaaataaaccaaccccagaacagcaacaacaaagtccaaatcctctttcttgtgcagactagtaggttaagttgaaagagagaagtgtttcagtaccatgcctcttatgttacagaatgcagcagtccggcgcctggcccaggaaaagagtgggaagagtatgtgcagatccggactctggttgagaaaatacggaaaaagcaaaaaggtaaaattgctagaatgataactgtattttaataatgtcatgtagaaacttgattaggtcaaagggttgacgagtagtaaaggtctcagcatcattggtgtcactctgaaaggtcttgtactggggcttgcagaccgggagagagagcagttagcgggatttctcccctttctgagatgctattacctgcttcggaaagggtgagaatgttgagctttaggagaataaaatgtttgtatctgggtgctaaaatgatacaattttatttatttacattttataaagtattataccgttatttccttttgagtttcaggacagtgcatatagtgtatatcgtcaataacaaataaatgctgattggttaatgcattagcaaggtttataatgaactcacacacatctcagttaaataagaggtgtggtcatattccttaagctgtgtttttacaggacgtatgcagtcgccattgtaatgattctcatccaggctggcgtggggctaagtgtgagtttgaaaaagctcattcactatacctattgtttttgttctgtaaagcacaaaaagtaaagattattatgcaggaccacatggaaggtagaagcagaaaacatcctaaggagcatgcattggaatgtggggccctttcttattgtcatgaagggcctcaggagagggtttgttttttatttgctctctttaagtagtggttttattgctcttccatacacatctctaaacatgtagtcttcagtttagatggtctcagactccaaaatggtgagttcataatgggtgttttcaaacaggttccttcataatgggtttatttgcactaaataggagtctgtgctaatcctttgtcaccaagtgggtagcgccttagtttctcttctgcgtagatactgtttactatacctgacactgagggtaaagcatttgccagttctcaaggagtgaataggaagttccgtctttgaatattcctcattctggtcattttcgccatttagcaggtatcttcgcatatccagcatgccctcttcacatatcaggttgactgttaattatgctgtggtaagatggccacaggcgcctgagctatgtgccacacccagcttcctcatagtaaagttcctgttcccctccttttattcatccaaacagaatagttttttctatgcatgtcttttcatctttttgactacataggacatgctgaaaagttcagaaattaatataacagatgtccaagaatctgctaccccagctgagcacatgtcaaagttgtattctcattgtcctttcttttattctcacccactgatcagctttcctttcccttcctcagcccttggttttgtttttgtatttgtttttaagaaataaaacatcacagatacagccaaagcctcacattttcatccccttccattccctccctccttgcagggtgttcatcttcactgtgaatgttttctacttcataaataaccccataaaaatatatggttgtaattgatatttgaaaaatttacataaatggtgtcatattacgtgattttttaaaagccactgtggtacatttagtgttatacttatgttgatacacatagctctagctcatttaaattgccttacagccttctggcttacagctctacagttttgtgttcttagaatcagggctgtggggctcatcctttcccatgtctccttgtgcacatacgcgagctactcatttttgttttaatggaaattttgttaaagcaaatgtgaacatgagaggtggcatgtttgacttttaaggagaaaactgctctgtaaatcatagtagtggtaatagaagctctctgccctttgccatcgtattacctaatagtacctaatagtcaatatttatattacctagtgtcagtatatatttcactgtaactgacagggagtttaggattttaattcttcttccctgtcaccagttaaggtatgtactgtgaccatctggtgattagttttgatttcaagattggcgtgttaagactatttccagtgttagttatggcctgtttttattttctgagagacgtgtgaatgatatgtgtcctaaaagtagctcttgttttctaaaacgtggattaatataggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggtgagtttataaaatgttggtctcaaggggtctatgtgtttgaactgtggtgtgctgtagagggcgcagggtgaagaggtagacgtgtggtgggggagttctagttctgagcctgtgggcagataggcagcctggaagggccttgggctcatgttctaagcagctcctcccaccttatcctcctggggagccaagttgctaatcagtgactggggcaagtcagttcacatttctgagcctctgttaggagaccatagaacatgcctcacaggattttgagatttacctaaagataaggaggtggactcatggtttggattttgtaacttactggaggtgagtgggtggaggactggcggtgtgggtatgcctactagtgtctgaaatggatgactatgaggctgaaggtactaggagctcactgaaatggcaataccagt

SEQ ID NO: 9354 - DNA, 1310 bp, Homo sapiens
ccccacccccacgcctcccgcctacccacgcagtcccccctcatcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgag

SEQ ID NO: 9355 - DNA, 2909 bp, Homo sapiens
tggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacagggattttgatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcatgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctg

SEQ ID NO: 9356 - DNA, 1165 bp, Homo sapiens
tcaaggcaggactgggtttagagggatattttgttactgattagcaatctatggctacaactcaggtttctctttgtaacactgtatccacccccacctcccaccacaggctgcttcagggcagtgggagtagcgcaaagttaggtggtttaatttgctggggctgttcagagcacctcagcccctttgattttgccgtcctgggggcttttgaggggtcagttatctgggcctcggtttccctaagtgcagtccaaagagcagattgctgcagtctcgtggctggaaagtgaaatgtttctggttttcagctgcgtcatcaatgacacttggcaagagtgcctctctgcaggacactggagggctggagtgtttagagcatacttgcaggaaaggctctgtcgagttttgggcaaggagatgcggccccagtctggctcagcatgtcagctgcgacagtgaataatacaggagtggaggactaggctacactgagttttccaccccactgggggtcagtgggaggttgaagtatagggtttcccacagaacccatcctcccccaagcccacttagcacaggactgctgcaaatgttgtggcagcaaaccttgctttggggtgaaatgaaaattcagcattattattacaaatttcggttacagatggaattattattatttagttttgtctcttaaagccatgtgtggccttgggatgtggtcccactaatgtaaatggaaggcttggaaaccaggaaaggcccttctcttagaaactgagctgttctttctttcttttttcccttttttcgagacagggtgtcactctgtcacccaggctagagtgcaatggaacactcatggctcactacagcctcaacctcccaggcttaagtgatcctcccagctcagcctcccaagtagctgtgattagagccatgagccacctcacctggtgaaactgggcttttctattctgggacttgtaactttaaattgagcaaagattgggcctgagctgagggagataatgagtctctgtctgggtggtgtctaaagtggggtcagacaccaggcttgcgccttatgtgtttggtctttgcttcttctcacaggaaccctggggaagcagtattatccccatttgacagacaagcaagtgga

SEQ ID NO: 9357 - DNA, 1186 bp, Homo sapiens
ggcagtccctggggtccagggccaagatttcctgctgacccctgcaggagctgggagggcagagcctcagcctccactatgttgggggaagggctcccgggcccccggcacctggacacccacctgtccagagcctacagagaccctgcgtccccacacagcagctcctcacaccagagttctggtgcccagcactcctcagcagcagtgaggccacaggcagggcacaggcctctgtccctacgccaggtcctcccctaaaagggcagtggcagcaggggccgccgcagaaggaatggcagatgagacccaaagcctttggtcatcaccccagaggtctatgccaaagcctgggtggggctcccaggagatggaacagggacacataccaggcaggtccacgccaggggtgcggggccctgatgaggaaccgggctgcactggtcatggctgcacctgagccgccgccacctgtcccgcagccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaccctcgggctcaggccctcgcattggtccatcacgctccgggctggggatgccccttttcagagaagggcccgggaccacggtgaccaggagtcgtaggagcaagatggcggtcttcgacaggaagctgggctcagaacattcccaagccccgggaaggtggggtggt

SEQ ID NO: 9358 - DNA, 1654 bp, Homo sapiens
atgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgta

SEQ ID NO: 9359 - DNA, 1172 bp, Homo sapiens
aaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctcccaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctgacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaa

SEQ ID NO: 9360 - DNA, 1267 bp, Homo sapiens
attttacagaagccataaggctgccaggaattgttgttgtttagtgcctgggggaatggcccctagcatcggtaggggtggggactgccctccccattggccctttcactgtgagaggccaagtcatggctatcgtcagagccaggtttctagccgttttaggaaaagtgtagctgaaggtataggttattgttgtggtaacaacagatctcacttctgagtgccacccacgtgccaggctctgcatgggtggtgtgggctgagctggtgcccgaggcaggaaggagccactcaggacatgtggagccatctctcacgtggctgtctccctccgggcaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcc

SEQ ID NO: 9361 - DNA, 1235 bp, Homo sapiens
tttctgcttctgccggcctcctcgtggtctcagtccacatctatcccccttgcactgcctcattaggcatttccttgcttatcaccttctctggttgattcgggcatctcagaccagttctgtccattgaggtctgagtgtcgtggaggctggtcccctgcctcctccccggtgtcttagacttccttggcaggggtggccctgagcaccctgcccatgtccccaggaggcaagtccttgccgttcagggctgcctcaggttggatcccctccaggaggctcccctgcctggggattgatcacttcttcctccccagtgctttgtaccagcaggttctggtggtagtaagagaattacagagagaatttgttggttgacatttttcttttttgggcttctttttactttgtttctgatcctaaaggaagaaaaacatattcatacagaggaatggaaaagtaccagagagcctgagaggcagtggggaggacacttcatcccctggaacttgcacctggcttctctgctcctgggtggctctgcacgtgtcttagttctgctcattctgtgtatgcaggcacttgccattttctctgtggaatttgagggcttggatgtgatttttagcatggacactttggaggggctcagttacattctccttggtgcacctcctggggtacaactggcattagcaggtgctgatgaaggagtaggaagtgctgcaaagcacttttgctcaatcgtgcgaggcttttaaaacccagttattactgctactcccatgaatgcccataatggcacaggaggttttctgaacctttctttattgcacaaatgctcctggaacagatcttgacaattcaggtgaattattattctacccctcagaaggtaaagggaaagctttctgtttgtaactttttcttcccaagtgtcctctgtcaaaaggtagtgacatcttctctcctgatatgtgacgtccattattacctcggtataatcataaagctcacacccaaaagctttccatccagcacgtcagagggacaatctttatttaagacacactcccccacttttctttgttattgctttctcctaaaaaaaaaaaacaaaaccaaaaaatcaaaaaattcccttggctttaaaggcatgatctgggctaggagtgactcgttcttttgcaaggttattgtcataggcaggaacaagacaggtgggacatgggggt

SEQ ID NO: 9362 - DNA, 1129 bp, Homo sapiens
aatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctc

SEQ ID NO: 9363 - DNA, 1214 bp, Homo sapiens
gggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttct

SEQ ID NO: 9364 - DNA, 1442 bp, Homo sapiens
agactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagc

SEQ ID NO: 9365 - DNA, 1222 bp, Homo sapiens
actggaattaatgagttgtgaagtgtcccaaggactggttccccctccctgctgtttctctgagccctgtcccctcttccaaaggaggaataaggaggtctagcttcgtctcccatccccgatttgagcagatggaagagtctagaaaagaggtgtaccttttgaaacgaggcctcagatgtggggttcctggtctggaaaggggaaggatgaatctggggtaggagagggtctcgtatggagccccattcagacagggcagtcccacacctgggctgcccacaggttcttgggggagtctaaggaaaggggagccacagaacaggcttgcctccttggcatggattgggtcagtgtttcagagccaggaaaggtgggagtgtggggggccctcggggctgatgagggcgtgcagaccctcccctcccacctcctgtcccaggagccctgcagacactgcagcaggagggcactctgccagaagaggggttccagctccagccggatccagcagacatggagagaccccttatctttgccaagacgagctctgcggtgcctgagaggcccgtaggtctggaattctagggccttctgggtttgagtcaggtcctgaggccagggcctgggccctgatcctcaccatggaaaactggtcactttactcaggataaactgtgatgaggacttgggacatatctctgtctgtcctctcagctcgcgtcacccctgagcccttggcgatcgtgggcggcccgtgtacagagcaggtgctgggtcactggggccgccgtgggcctcccaacatgagggactgtgtgtgagagaggagttcattaagggagaggatggtggtgaagggtgtagccatgactttcttaactgctctccaatttctttgagcttaaaaataaatccagatggagagttcttaagtcccctatcctgggagaaaggaaggctgcccaccaccttcggcttgcctcgactctgagcagtgaatagggtctttggcaggggcttaaggaggagactcttagcctgggagctcccagggctgtttcagatggaaacaaaggctcaggccgagaggaatgtgggggagccccccgtggggaacagccacctggggataattgggagggctgagcgcagatgagttttcccaggttctgtgaatgcgccctttcaatggaaggtgcctttttttccagatgaaaag

SEQ ID NO: 9366 - DNA, 1199 bp, Homo sapiens
gtgttctagacagtggaatgaagtggtccccagggagggtggctgtaggcatgtcatgtgcttgtcacatgcacttgccctggcagggaggagctggctcaggaagaccctggtcttggggtgctgttgccctatcttggctgtgtgggccatttcactgcatctgtctcttcctcagtttccccatctgtaaacctggagtggcaccagctgcctactagagttgatcttatgtgtctctgttgatggtaccccatctatggcctggataggcaggaagggcttggaccctgagccccgcagaaggttgcatgaacgagtggtgtgaagcctgttgggtagcttggccactcccgcggcatgggtcacctgcacaggaggttttgcccaccagggggcagcagagggtcagggagcaataggccctgggtggagcatgggccccgcctgctgtgtgccaccctgggtgtggcacctactcacatccaggggttggtgcagggaaaggccagaaggtggccaggcgcacctgagaagggggacccagaagccccgggacccaggagccctgggcaagccaccagaaaccttgttcttgcaactctctgcagtgtgcccaggccaccctctggcctggtcttccatggggcagggcgcccacccttctcaactcaggtttccctgggcagcaggtgcacctcagcacccctggggttgcagaagtggtccggggaccctggcttccttgacatgccatccccagagcctggttcaaggcctctctgtcttctcggctgtttcacgacgtgttttgtaacttggcgggattgcgtttcgctgtgtcgaggttgtctcttctctgactcgccctccgggggactgccggggtaaatctggagagttgctcgtgctgacagtcctcccccagggcctccccggttctgttgagtctcctttctctgtagtggaggaaatgtgtgtagttttgtgttgtgtgcctgtgtttgtctgtaaaagcaaggaccaaagtctcccttgttgacctctcaattcctatttgggacatataaaaacactggattcttaacaagcgcccggagcagtaggagcacagcttggatggactcaggacttgtggcagggagcacgtgggaggcaggggagtggggtggggccaggccatctggagtgggaggcgt

SEQ ID NO: 9367 - DNA, 1172 bp, Homo sapiens
gggggagatccgtggctttccaaaatcccttcatggggtctgtaagcagaaatgtctgctgccccctgttccagggcacgtcccactcctcactggcagggctctcgggctcactgattattctctgaggatcacacagggtcgattttctgtgaatgcaagtgcgtggggtgggtggtggggcgtcgagctgaacgctggtctggacaggaaaggctcctgcttcatgtcccaccttgaccctcagaggtttccaggcccagctcttgggccctggcttcctcctctccctctcgtctttggggggggtccatctcatgcatgtctgttaccatggactccatcatcacggctcccatcacctccatctggcctctgtcatcctgggcacagcatctcatctctggccattccagcctccatcacccgcctcacctccatcatcctcgcttcggggctcattctggcctccagggctttgtacatggtaggctttcattcattcgtttgcacattcggtgaaggtctactgtgtgccaggccctgtgccaggcatcgtgtagatggacgttgcccttgtgagtgcacgcctcggggagacgcacgccagccggtggatggcaggagagcctgggccagggctgggggtgggggcgtgggtgtgggcatgagtgcagaggagggtgagctggtttccagaagggcgggatcagctggggtggtgggcagggggaggaagtgcgggctcagctgaggtcctgctgtgtggagcctggagggagagattgcatgtcccctctctattccccatgggtcatctcagtaatggctgccggagttcaggggtccctagattgctcccaaggtcctcactcccaagtccttggcaagattcctgcgccccaggagccttttggcacctgaactctgccacctagtctgctggtcagcctctgtgctgcccgcgttggtgggtgtcattggattgttaacgatgtacgttttgctctaaaatgatggtgattgaagatgggaattattttgtcagttgattttaatgttttcttttttgtgtgtgaagtgtttgttgtgaaatatctattttggaagtttttaggtgttggaaagccagaatctggggccctctggtgtctaggaagaacctgtgatgc

SEQ ID NO: 9368 - DNA, 2867 bp, Homo sapiens
agtttcacccctttgggggtgacgacgaagcccaggaattccacggtttggcggtggaactggctcttgtccagggagcagtagacgttgtgatggcggaagcggaccaggacttggcggacgtggtggaggtgctcctcctgactcattgagtagatcaggacttcctggccataagaaagcacaaagaaccctagcatgtcctttaggatgaagtgaatcacgttctgaggtatgatagggtctggggagagcgcaaacggctggtagctcttcatctcttcaagctccaaaccaaacgctgctttccacacatcttcggtgcggtgcccgttcacgctttcctccacaatggtcccacgcagctccagttttgtgaaccactcggctccgtgtaactggtcaaacagttccggaatcatctgtatgtagtcctgtctgttggtcagcatgtcctgcaggtcccagtattcctcctgtagcctggctctttcttgcatcctggcacccacaggttcccaaggcgcggtggagggacactcgtaaaaggtctcgctgtgatcactgtctccagcctgctgaagctcagagggctctgattcagaaagatcatcggatccgtctgagcttggctggtcggaagtctcatcatctgcttccttcgggttaaacacgtcggccaggtctgagtatgggtgtggcagtccgggtagcaggctcatgccgtgcctctctagggcaatgcatggcgggggcgggcggaagcagttcttcaggcagtagggagagtggaaggtgcagcggcctttgatccagtcgacttcgggggcgtggactcggagccagcggatgcctaggaccacagagaagttcggtgaaggtacgatgtcaaattcgatggactcctggtggttctggtggatacacaccaggggctccgtgtagagccagacaggctcgttgccaatcagcgagccgtccacggattggaccggctgtgggtacggcttctcgtagagctcgacgtagtgctcttgggcgaacttctcatccatgaagttgccgtcagctcccgaatccaccagggcctggaccgcgacgctgtggtaggggttcactctcaccatgagcagcaggaagaggtgggcgcgattgatgtccggatggacttcgctgggcaaccagctgctgaccatccacctctctggagcaggtgagtcgatccaggtcaggttccgggggcgggcctcggggggcagcctgagcatagctcttctctctgccagcttctcttctatttgcaggatgagcacaatcagactgtctagggaatccggctgagggacccggaatagatagtgcctgatctcctcgttgagcccctggcacaagtgggcctgcaggacttcatctggccagcccaagatgggtaccaggctctggaactcatcgatgtactcagtggcagagcggccgccctgcctgatggtgaacatggcctcttctgccacacgcagtgcctggcggtactcaaacacttcggacatggcctccaggaaggctgggaagtctccgatcagggggctgttttcctgcagtagagctttggcccattctaatgccaagccggacaggtgattgatgacatagccaactctcagacggtcgttatagaacattcttgggtagctctgtaaggtcagttggcagagtacgatgaactcgtggaattctctgcgatcgccagagaagtgctttggggcgggcagttggcctgcattgatccctttgatcaagatctcttctgctactctctgttgctctttgaggtcttgcattcggaagtacagcgagatgatggacctcaccatggccataagttctgcggttgagtgctcggtctggttttgctcttgaggagtctcctcccttcccgattccttcaggtcagtgtgagcctcttgttcttctcgggctcccgatgggttgactgatgcttctttcatcctatcagatgctccactgagtggatccccccttgcctggtgtgaaccgttgcatgactcctccaggtcttggagtaggtcattgggtggatcctctatttccttacgtgggccactggatggctcctccatgtcttggagtagatcagtgggcagctcttccatttcctggagtgggccactggggggctccttcttttcctgggctgggccgctggctggccctgcctctccccgcactccactgcccgacgtcgcctcggtggtgttggatgagccctcggaggactccatttgttttgatgatggattcttatgctccatcatcgtctcaaatgagtcttcagagggttctatcatttcgtcggatggaaaggagtgtattctgaagattggtaaggttgtgatggcgtccagtcagtagctgggaccgtggagatcagaacctggtggtggaaggggagtgtggggagtaaaggcagtagtttaggatcttgtgaagtggcagtatcagggtctcaaggacaaatcagatgcccaactaatcagagcagagagaaatgggggaaagccttcttgtatcgagccagcctctttggctggtcacttggggtgcccccagggagggaagatctgtcaacccctgacctgcctcccaggcttattcagtctgcctgtcctgtccttttcctccatagatgtgagaaattcacagcccataaattctgtggctgggagcagccaccgtggcaggcgggtacctggcagggtgcacaggctgctccattcccccctggcacatgcacctggtcaatcctcttttcctgctttggtcacctgagaatcacagaggtcacatct

SEQ ID NO: 9369 - DNA, 2867 bp, Homo sapiens; identical to SEQ ID NO: 9368

SEQ ID NO: 9370 - DNA, 2867 bp, Homo sapiens; identical to SEQ ID NO: 9368

SEQ ID NO: 9371 - DNA, 1236 bp, Homo sapiens
cttagtgatgccggtggcttcctgtcctcgaagctcagtcggtctggtgggggaaacaaacagggaataagacactggaaattgaggtgatcaagagggggtgcaggcatggagatttatggagccccgtcttggagccaagtcccgaactgggctgtctgcaaagaactcacccgggcaataaccctgcacactggtctcatgagccccattagattgatgaggaaactgaggcacagaaaggcaaagtcctatactcaccgtctctcagctggtgtgaggctgggccaggatggaaccccagactctccgaggctccccaccacaccctgctgctgaaggctgctcagcgaggctgtgccgagtgctgggggggtgtgggtgggcaggggacggattgattagttataagcacctcccagcggtgcttgagatcccagctcctctgtggcccaatccgtttgaagggcagattcaaaattaggtggtagcacctatgggcagaggcttatgaaaatggcattattaacctgatgtggagagggccctgcctgtctgcaagtagattgcagatagagacggagggggctgggcttgtttgtgtggacagtgagttagagaggacagagaacatccaggggccctccagggcttccggacggggagaaccagatctggaggggctggacaagtgggagggggaagaggggtacgtcttaagggtgccccggcacctcagggaaatgccccaggctggacttggaggaggatctccagccttgactctgacacagacagggactatggccctccccgcacctcggtttcccatctgtgagataagagatggaaaccaaacgtcatttcgagaaaagcccccattcccaccaccctcctggccccccccttcccccaccaccccaatcacgtttgccagacacctgtctgcttgtcagagcaatattcaacaggagagttccttcgcttcctccctggagggagaagggagaggtgtggacggggagaggggaggggagaggtgccccccactcagagaggccgctgagcagagttctgcatcgggtaggagttgggccaccgaagatttgtgccaactcacggtgcggtggaatcagacagtctgaattcttcagacaccagccaagagtctgtggcgcccccacgtgccacaagggggctgcctgggccacatttctgagcccgaaaagtgaggag

SEQ ID NO: 9372 - DNA, 1204 bp, Homo sapiens
ccacaaagacagtgttttatgacctaaagattaagatttatccatttgtgtacaattgtggactatataaaataaaacaagactttgacctcagtggataagaagtatttggatgtactaatcaatatttttggtctgggtcagtggtgggttcatctgtgtttgttgtatttaaaaaaataaatgaaaacattgaaaagggtgagtaggaatcaaatatgattgtcactccaagtctgcgtcatctgcatccgttaggaagaatatctgggttggttccttcttgggtaagatgcacagggacatatgtttgtgagagtcatgattcttgtttttgattagagtggtgaattaatacacactcatttgtaataatacaaattaataaatgaataattgcggagagctatgcttgggccagtggtgagactgtcatgaaccaaagattatgattaatactgtgcttctcacctgatggccattaaaaaaatctaggttttttcatcctttttaatatcagccttgtgttccacagaatggaggctccagagtgaaattaatgacactttgtcgatgaagatcttgattgtgacctctgtggaaaatgagccatgaaccaaccaatgtgagtaatgtttagtgttgttgttttgaagttgggtggttggttgatggttgtttattacattattaaacatgaatcaatacataaataaggtcaaagatgacgggcatgatgagaatgtcatgaaccaagggtgattaatttcatatagcgtaactgttaccaaattaaaaaacaatattactgggctgttctctgtagcaaatgagcaaagaaaaaaaggaacacacacacacacacacacgtatactacatatatatcacatgtatcatgtgttatgtttatacatgtatcctatatatatatcacatacgtaatatgtgttatgtttatttttcatatttgcaggctggggtgggtttatatatgtttatggggtaattaaacataaatggatgcatgtataaacaagatcaaagagagtcaagcatggactaatgaagacaatgtatcatgatctaagatttatgattgcacagctctgcaaattggagagacattgaaacacaaatatttatgctgtttcattcatttcagtagcattccactattaatttatgcactacacttttgcatga

SEQ ID NO: 9373 - DNA, 1218 bp, Homo sapiens
aagcatgggccagtgaggaacaggtgttatgaaccaaagataatgattactccagttatactctaatgttgtccagataaatagagctccaggttgcccctgctttggataaagcacacattgaaatttccatggagtaattctttagaaaaacagatatgtaatttattccatgcataattgtatatatgagtaaataagtgaatcactagacatgtaaatcagaaagattttgcatcattaatgagaatatgccataaaacaaaggtttacatttatctaattttgcacaagtgagatccactaaaagtgatcacctatctggtaaatttatggatctggagtatgtagacagatatttatgatagatatggctcttattctcatgttgatattcattgtattatttaaaagcccaaactacacaagtcaataaataaggagtgccatttttgggcaatgatgagatgaccgaagtttatgattaatctaatactgccaaacaaatttccattaaaaagtctaactgtagggtctttctttctcttgaaagtatgtattttacttcaccaaatgagcacattatggtgaagaactgatttagtcattctctaatgctaaagatcttgccttttacttctgtgggtaaggagagaagagatttatgtaagtaacaattagtgtttactgttcttggattgggaggttggttcatgggtgttgcctgaatttattaaaataataactggatatattaataaataaaactaggtaacaccaatatgtaccagtgatgagaatatgttcagaattgggatttatgattaatctgatttggtactagtaaaattcaataaaaaagatacagggtatttcattcattttcagagatgattcagattgttttattattgcgttgtgattcagttaagtacctctccattgataaagatttaggctattaattccttgagggaggagcacataggaagatggacagtgttgtcagtgttctagttgtgcagtaagattatgattccttggtgattcattataccatatttggcacttgaaaaaggaccaaccgtggaccagtgagtagcatggagctgacatgaaagaaggaagttgattaatttataagtgccaaaagtgcatatatgtatatatatgtatacaaactcacacacacatatgttgcagaaagtgacttccatc

SEQ ID NO: 9374 - DNA, 1160 bp, Homo sapiens
tattttaagtgaattcaatgcgtaaatagagaaatgtgtatacatgagagaagattaacagtcctacttatggaactattctttgagtacaatgaaaaagtattataaatattaacactggcaataaaacaagtataattattaatctgaggtaaaatcctattatacagaacatattgtatctgcagttgagacaatttttttggttttatagtttgctttttttttaattaagaaaagggaaagtgtttgcatcagccagaaatccattaagtaatatctacttaacagatttttatatagacaaatattcataatcattacagatcttattcttgggctaggtgacgcattagtgtctattatactatttaaaactaaaagttcaatactggcctgaaaaaattgcatttttgagccaaggtttattgttatctagttctgcttgactaacatccattgagaaaaccgtatatctattctaaatctgcctttttccctccagagtggacataggccagctgatttaataatttaagaaagaactgttatcctgagtaaggagcatagagacaaatataagtaagttccttatttcaagttctttctttgaatggtttgtttttgggtgttagctaaaggatttcaaaggaatcaatgtctacatacgtgaaataaataacacaccccaaatgcaccaatgatgggaatgtgtaatgaaccatgaattatgtttaatctaaatcgtcacaactgagttgattataaaagaagacaaaagttaacttattctcagagcagctcaacattattctttatttcatgccatggttattttacacgttcccttatgggtagagatcctggctgacatccgttttggggcagcgcatgagaatatggaaataggtgatttcgttgttttttatcaggccatcgttgacatatgtatgaattaaatagaagtgggctatatcagaacgaatgctgaatgtgaactgagagcatgcaggggcattgaccaattcacatgtgcacctttacgtgtcatggcctaagaaatgtagtctagctctatgggccaagagcctaaaatttaatgatcttgttttggggatttttgattgtatcgttatttgtgagtcaataggtcaatcaat

SEQ ID NO: 9375 - DNA, 1186 bp, Homo sapiens
gaggttcttagtcccaataaattagtggctaaggctctattcattttggtaaggagcatatggtcatctgtgcacaagactgaatgtttttgttctgtgttgaggcaggttactggttgatcattttattaaggaaaaagaaatacatttacataaataaatagttgactgagtaactgtaattgagagagggagagcatggaatgatgatgagatctatatacaacgacactcatgattaattcagtcttttatggaattttacttaagcaaacagacaagtttggtactagattcacagcgtttattatattatctaaaacaaaaaatttcatggtgagagatatttcatcttgacaaaaacaatttatgtaagttaataaatagaagtgttctctcttctcaagtgttcagaatagggtacaaaacaaggtttatgattgtttactacagagctatgattcattttaaagagctaaacatatagtatttgattctttttaaaatttgcgttttatgctgcagaatgaacgcactctacctgatttaattatagtcttctggtgaagatcttgctgttatctctgtgaatcaggagagaagagattgatgtaagtaaaaatcaaactttgtgttctcgcttgggaaacttgatcaagtttattcattgaattatttcaaaggaataaaaggctacatacataaatgagtcaaaggtggttatgcatggaacaatggtagaaatgtgttatgaattaagaattatgattaatccatttcagcacaacgaaattcattaggacaaaaagttgaaaggtatttctgtcattttcagaatgccttaatatgctgtttttgtaccatagtggatttaaatacttccccattgtgattgttattgacagttaactaattgagggaagaacataagaaaatggaaaaccttgcctatagctgtggtataacttggtggttataccatgatataaccatagtaacgtcttaaaaatacggatgttaaatgaaaaaagcccaaccatggactaatggaatatatggaattgacgtggtgcaatttgtggaatgaattaattcacctttgcaatactgaggctcattacagagagagccagtcctctagttctgtggaatatgaatcttacagacatagttacttcttcaagga

SEQ ID NO: 9376 - DNA, 1164 bp, Homo sapiens
catgaaaagcatttctgttgtgggttcttcatgagtttactgctctgtgtgtgtgtgtgtgtgtgtgtgtgtgtgtgttagtatttgtgaatgtataatgaaatattccatgcgtcataacataaacaaatcaaaacaataaatgaattcatatataagtagggtaaagcatttaccattggtgataatatgccatgaatcatgaatttaaattcatccatttctacacatgttgagtccattaaataaaaaagatgatctaaagcggttgcctgtgtaggtgtctatagacagatgtgtgccatagtcatagtttttgttttgggtgatgaatttaacagtgtttattgtattatttaaagttaatagttaaatcaggaaataaaaataagtgcagttcttgggtcagtgataaaaatgggatttgaatcaactttatgattaatttaatatcacacaactaatgtcttttaagtcaatctaaatctgtactgttcattcttttgaaaatttgtattcaactccacagaatgaagaccatggttgatttaatcagtctctgctgatgaagatcttggctgttacctttgtgtgtaaggaagctaaagacttaagtaaataacagtccaaaaacttgtcaattagggtaaatttttcattaatgttcactgaattatttaaagttaaggcatatgtagatcaatgagatgaatgtgttatgaaacttagattgtggttagtccaattaagcacaattttggttaaaaataagatgaaagacattttattcatttttttatctgattaataattcatcttattttgtactgcatttaatttaagatttattcactaataaaatctatggctgcactgttcaatgtcgtttcctctatccacatgtggctatttatatttaaaataattaaaggtacatgcacttttaaatgtaatttcttggttgcattagccacatttctagtgctcagcagctgtatgttgctattggtgactgtaatggagaacgcagttacagtacgtttacattatatgcaaagtcctgttagacagctctttaatgagggaggaatgcatggaaaggtggaagataagtggaatgagatggctaggaagcaaggatgttcattgatctatacttgcttc

SEQ ID NO: 9377 - DNA, 1088 bp, Homo sapiens
gaggtccaatataataaaaaatctagtcttcaccttctatcctagggatagacattaggaatatttgaggatgttgttcttggtcttcacgttcatgcattttccctctatttttataattggatcaatgaatcaataagcaaatatattttaactgcataaagataaaaataggcgttgtccaattatggaaatatatggtgaaataagaaatactattcacatttattaaaaacactgaggtcttctttctattaacaaataaatgactcagaggtattactcgcttgctgcaggatggcatatacagtaaaaataataataacgtatgtgaggtcatttgggtcaggaccatgttcatggttgtttgttttctcaagaaaaaatagtttcacacatacttacatgactaatagaatgaaaggagaaatgtgtggataaatggacagaatatttccatctttttatcttttttgctttgtactctcacaatgaacaccctcaagttgacttaagcacccttccatggtcatgaggtttctggttgcctctgtgtgttagaagcttggagaccaatgtgagtatagtcaaagttcttgtcttggttctgggtttttaaggggtagtcattgttttattaagaacattacagataatccaaaaggttaaccatggtccaggggtaattatggcattgccatgaaacattatgttgattatctaatatttataaaattaaaaatgattaatgataaaatcactgtgagagatgatcctatagagagctatacagtatttcttgttcttaagtttttgtaacattatttaattactattagtgaaaggatgaattaataaataaacaaatgtagaagtaatggagaagaggagggccagtcttcagtcaatgatgactctgcctctgttgaaaataccataccctatagacagatttaagaatacacaaggctcatgttcttggtttttgcattaatggattttgattctattattataaatagatcaatgaaagaatcaataaagcaatagaaacacacatgagtaatgaaatcatcgtacaattatga

SEQ ID NO: 9378 - DNA, 1212 bp, Homo sapiens
atatcctcccaatgaatgtttgccttaattactggctaaacggtagacacaaagcagggaaccattgccataaggtctcaaattttttatcaacagtcctactttgtacaccttagaatgggctcacctgagttgtctcaagcactccttcatgccctcaggctgtacagttgcatctgtgtgttaggagcttggaggccactgtaagtaatagtcaatgttcttggcttgagtgcttttttaaaggatagttactacagtattaaaaattatacaatatataaaagaaggccaactgcagcccagtgacaaacatgaaatccatatgaagtagtatattgattaattcattgaattaattcatttaagaaaactgaggatatttagtaaaggagttacattgacctgagaatgattctatacacatattagggacatcgaggcttttttcaggttttgtgcattatagcactttaaacatattattagtaaattgctgaattaatcaataaacaatgcagaaacaaatgaagaaaagatgggccatttctggaccaatgatgatgactggtggtgtatgagttaaaggtgatgaatagtaagtgtctttgttagtggcaagttcagagtcgtttgttttaagagaatatgaaataaatatattccaaataatgatgatttaagtgactaaatgaaaggtgaaaggcaaggatcattggaggaatgtctgaatttttaaatcatctgttctgtttatactcctcagaatggccccattccagctgatataagcactcttccatggcatgtgcactatggttggttctctgtgttaggagcacacaaaccattgcgagtatgcattcatttcctctctttacaaggtgcagtaagttggtgtcagtgatatacaagaatctttgtgttcatgcatttttttttttttttgagatggagtctctctctgttgctcaggctggagtgcagtggtgtgatcttggctcactgcaacctctgcctcccaggcatcatcattggtccagaaatggcctatcttttcttcattcgtttctacattgtttattgattaattcagcaatttactaataatatgtttaaagtgctttaatgcacaaaacctgaaaaaagtcttgatgtccctaatatgtgtatagaatcattctcaggtcaatgtacctcctttactaaata

SEQ ID NO: 9379 - DNA, 1076 bp, Homo sapiens
atgaatgactaactgatagttgaaaagcaaatatcaatattgaaaatgtctcaattttgtcattatcttctctggtctgtattcctcagaatgaacaacttgtgctgtgttaaggattcctccatgatcacgcgccccatttgtacaccatgcttgggaaggtgcatgcagaccaatgttagtaatagtcaaaattcctgtgtcggtttgtgtggtttgctaaacaggactcaatgtatcatgaaacagtgtattatatagtcaactatggtcaactatgtcccagtgatatttatgagagggatctgaagtatttattgataatgcatatatgaaaaacggagaagaattaatgaaacagatatatctgtgttagaatgattctgtataaagatagggaatatcaagtctgttcttagtgttttgtgaatcacagagtgtaaaattattcccagtgaattaatgaataaatttaaagacaacatagaaatgaatgcagaaaaagagggtcaaccctggatcgatgatgagcactggtggagtatgagtcacatacgatgaatacgtgtctggaactctgaggtccatcgcagaagtcagtttcctctgtttcaactaactctgtagatagatgacaagaatagagaatgaattttttttgtttatgagtttttattttataattggttcaatgaaagaataaaacatatatgaataaataaataagttatgcattgtccaattataaaaatgtgtgatgaggtgtatttaatacgtatttaaattgatgaaagccaaaaataaatctaacatacctaacctttttggccaataatgaagagatagtataaattatatgctattttcgtgttcttggttagtggcaagttcaaagttgttcatacttcaaataacgattgcctaaatgtttaactacagataggtaaaaaggaaagatcaacaatgagaaaaatcacatttttgttattattttctctgctctgcactcatcagaatggacgtacttgtgatgatttaaagatgcctccaaggtcacgtgctctgtttgcaccatg

SEQ ID NO: 9380 - DNA, 1944 bp, Homo sapiens
ataaaataggacaggtagatgggctttctagaagcacagaaggtatgccttcagctcaatctcagtgtcagttgagttgtggaagagatgactcctgagccagtgacagactcattagtccatagctccgcaaagctggggaccacactcctctccttcactgctctgccccttgtgccttacatggacagcacatgcaataagcatctgttgaatgaataggtgaatacatggtgaataaaagaatggaggagtgaagcagtatatgaacaaatgagtctttgagtagacaaaggaacgaataaatgaagtaatgaaaatgggaatgagtacacgaatgagtgaatggatcaatgataggtccatgagtgactgaatcagtgataagtggataaatgcatggcgagttaatgagtgggtgagttcatgtgtaagtaaaaatgtcacaaagtgaatgagtggatgatgaatgactaagtcattgagcgaatgaatggaagattaataggtcaagtagtcaagaaatgaaagacaaacatgtaaatggatgagtgaatcaatgggtccatgaattcttgaatgaatttatgaattaacagataaatgaaagtcaatgagtaatgagaaaataaatgaatagatgagtctatgtatgaatcaatcaatgagttaatgactcattgaagaaccaaatgaatgaattaatctaggaattagtgagtttactaatgaataactcaaagaaagaggaaacaaccaaataaattaactggataaataagtcagtgaatgaaacaaattatgagcgaatagatagacaaagggatggataattgatggatatattacagctagtgaataaaagagtgaattagtgagtgagcaaatgagtcagtgaatgagtatgtaatcaaggaataaattagctctgggaatgagtaagtgaataagtgaatgagtcaataaattagtgaattagtcacttattgaagcataaggcagtgagtgaatgaactcacactgggactctttccctgactgttcaacagagagtagtcatgccccagcttcacaccacagcataaataactcaatcagagcacccaccctacgctatcgtgggcgtttgtttacatgtcatcactaaactgatgtgccgcaggggccaggaactgggtcaaattattctctgtatccctggtgcctgcccagctctgagcctcggaagagcacagtaaattgttgctgaatgaatgaacgatagctaaaaatacattggcttttttggaaccaggatggcccatctgagaatggtctgggagctgttctttggggagatgtgctgtgtgtcagatggtttgtggcatcctcctacgcaagtctagattctgccttgaatccagcttcctgtgtccagtgccagacagcgagacaggatactggcagttcggactgccctggacattgccccatccttgggcaatgctggcatggcatggtgaaatgaaagccctaggtcttcccgaaagctgcccttgcctctgccaagacaggagatcagaaataacccggtcttgtttttatgcctccagcgagtgggcccactccatgcctttccaagcaaccacattcctccttgctgtagttgtgggacactgggttgaagcaccccttgacctttatctggtagatgagaataacaatccctgtctggctgggtggatgtgctgctttacgggagattatttaatacatgttacataggtagcatggtacctgggaggaaagagatgtctcagaaatgttacatgccagttttcatcatccccacctaacgtagctatatttgattatttcaaatgcattaatttaaaagctctcaaatggatgtgatactcaaattcccctcttccagaagattggagagttcaactgagttctagg

SEQ ID NO: 9381 - DNA, 1212 bp, Homo sapiens
tgctgttgcctccggggtatccagggtaggcggctgctgggtccatgtagattgggtgctctgctggctacggaggggtcaaaggacaggtggcaagggtgcagagccgcagcctggccctgggattttcttctcagacctctgctccggggtccaccttcgggggaaaagagggcacaattttacaactttgtaagaggaaacctgaagttttctgacccctgattctccccagccctgtcaggattgatctaactctctgttgagatgcaaaagagtctggagataacagtactccccccaccatgaaaacaattattgtcaaaggagttttatagcaaacagaaaatccggcccagaattggctaaaacatttggggagctcacatcaggaaatgagattcgtttttatttcttgattctgctgaattggattgaaggcagcagaaggcattaagtgggatttgacctggaggaaggtggcctggcggtgctcctggcttccccgaccctccctccctagccgtgtgtagcaggcactcactttgcttacagcttcctcggtgccatgtatctgtttttggaatcacaccttgcctggaaggctgcttggacccatggccagtgccacacaggggcctgggcaccggctaactgcagacccagccacctgcttcttgaccacagaattcgagatttactcatgagctctcttgacgcactgactttgggatgcaaaccattatgactaggggcacttcccgtggcctggacttccacaaggaaaccctggttccaccgtcaggaaagctccaatacctggaaagaggttgtacctaaagtgttctctgtattggcggaaaatgtttcccgggcaacctcttttcattgtgaaggcttgaagagcttttggctgacttcccaaaagcaacctgggacacgcaaatagaagccatctgacgtctggtctacccagtgccatgtagattcggggaatcttcctggaggtgacaccaacatcggcgaagattcggcagttctgttttgattttttttgtttgttttttgatcagtgctaatcttcgatactcgaaggagaggttgtccgtgttgtcttctctttatttatgatgaaacatacacgggaaacctcttttttagtatcaaatcccaccctggaggcacttcctgttcctgatgcagccttcaggg

SEQ ID NO: 9382 - DNA, 1212 bp, Homo sapiens
catcctcaggcggactagctggaaggaaggcagactctggtgaagacgtgggccgtcaccgtcagccttcggtacttgaagagtggttatccctgctgtgttcgcttaatttatgacgaatcatacagggacatccagtttttcagtatcaaatactgctttggaaggcttcccggacagcgtcccgccttcaggcaaggggtcttggcttcacctcccacccaaggtatgtatgtgaacgggccatcgcagtgcactagcttcttcatgtgccacagccatgaccagaatcgaatctctgaggaagatggttacttctaaggctgtgattttctggaaggggctttggtgtctgcactacattattgggggaagttgaccagtgagaggcccattcacacaagacgtctgtcacctgctccaagtgaccctcacccttggtaagatgaatctctggagacatgctggctcggtagtgttactgtcatcagccggactgactgataggtaattggtcatcattattgcttttgttccagggcagaatttttgagtgccaaatcttgccagggaagggtttctggaagcagcaccgccctctggggagacttggcatccacatctgttggagtttgtggagagttagttgagcagtctgagctttgtttctgaggcgtctccctgagctcactctcctgccagagctgtgtcctgcccatggccataatggctattgagagggttggtgactttggccaccatgattttgtttcgataaagttctctctttttaaaaaaatcagattcttttgtttatagcataactacatggttcatgagttgatcaaataacaaggaatgacttggtcattccataaatagtgatggagtgcacactgtgttctaggtgattctggaccttagcagagagcagtgaatgaaatcaagttcttgctcatgtggactttacattctggtggaagagacggatgagaacacatgaattaggaagcgtaattttgtccactgctaggttttatggggaaagggaaagcgggttacagtgacagaaagaggtaaaagcaggtggacctttgtgttaaatacaggggtctggaaagctctctctgaggatgtgggtgggaatggagtggggtggaccagaggaaggtctggggtaggagcatttcaggaggagggcaaggcccatgg

SEQ ID NO: 9383 - DNA, 1404 bp, Homo sapiens
ggtctacacactgcggagtgctcctggcgtgtgacaagtggcttccctcttcttatttctaaaccttgtgcgtgtggattcaggaccacaatttcaactccagggaagggggactgtgccagcaccactccaagggaggtgagtgaagggttgcccaaactccagtgtgttcctaggacacccgtaagctgcctcactaatgctcggtgtccactctgtccacaggatggtggttggcagccactccccttggagaagtggaaggggactccttgtctgtcttgtctctgcttttctgtggtacttgaagagaagttgttcgtggtggattcgctttacttatgacgaatcattcacggacaacacttttttcagtaccaaatgctacctctaaggacttcctggacacaatggcagcttcaggaaagatagtctttgtgtcaaccatgtggaaaagccaagaatggatggcgggccatggacaatgcgctgacctagctgtaagtcacctggcccgataatccgagcctcccatgcacctataggaggtcttcccatgggtctcaccaactctggggaatcagctgtggttctgtcaccagcgtcacctcacaagactttgaagagaggctccctgggccccaggccgacttccagaagagatgttggtgtcagcaccgtccagggtgtgtgactggttgaccagaggggcatgcactgtgttcaccctgtgggccacctagtcaccaaccctcagcatcactcccactccaggaagactttccagagctcccaccaactctggggaagcggccatggacttgctgtgactgcttggtggactgcgatgacacgtgctcttgggggtgtatgtttacttaaaatgcaatgagtcagccttggcagccccttcaccactgtgacagcctccttgaagtgttgacttccgatgtgggacgccatgttgtcttctgttgagggacctgatgtgggccagcttttctcctgggtgtgtgactgaatccttcttcccagagcatgtgctgcctttgttaggtctgtcacgtcgtcctctaatacccagcatcctgtctctccctaggaggctccatggagataatgcggctttgggaagcggccatgattctcctgtcagggaccagtgagctacgcaaaagctccctgtcttgtctggaaggacgaactgcatccttgctgctggggagaaggcagtgccctcagcactcccttaaggtaagtgcgcctcgggtgagcatgcacttaatgtgggtgtatgtcactcggctcggcccactacccaatactatcccacccattcctaacaggactcccgagaagggcggccacctctgccagagaggcaatggatttctcaccagtgtt

SEQ ID NO: 9384 - DNA, 1404 bp, Homo sapiens; identical to SEQ ID NO: 9383

SEQ ID NO: 9385 - DNA, 1404 bp, Homo sapiens; identical to SEQ ID NO: 9383

SEQ ID NO: 9386 - DNA, 1120 bp, Homo sapiens
ggacgacgaatgttgctcggtgaaccccttttcggtatcaaattccaccagggaggccgtcttggaggctggggcacctcggggaaggacgccggcatcagcaccattctggggtacggggatggatggtcgaccagttggaaagtaattgtttctaatgtacttcacctggtccactagccgtccgtatccgctgcagcctgtggggcctgcgggccggggagccgatcgcgcttcagctcagcgcctttcctggtacttgaagggagatcgaccgtgttatattcgctttattgacttcgaataatacatggttgatcttttctcagtatcaaatctcaccttggaggacccgttggagatgaagcccttttgagggtaggagcaggacgggtgctttggagtcgctgcctcagtggggcctggtcaccgagagtgggccgggcaggggtctctttcctgtctctgtgtcttctcacctttgatgtcccatccgtcctcaggactgcttcccgggggcagcgctggcaccacgggacgcggcagccacgttcttgagccgatggcactctgggtacctgagaagaggttgtctgtgatgagttcgcttttattaatgacgaatataacacagatggcctgttttcagtaccgctaccgcccggtggtgtgcgggcgccacgcctgaggcgggactttccagggtacgtgaatgcatgggctggtgtgacatttgtcatcctttcccctgacccccgccattgaatcattttgggagagctttcggggggccatgtggactttggggaagatgctagggttgtgcactgtggtggggggcggtcatgaagctgatgagcaatggtgacggggctcagtctgtttttcatggccagtgtcatcgaggcagaggacacgggggagctagtcccgctggaaggcatcctgctggaaggccacccacccctcgccaggatgttgggggcggctgcatgcattccctgcacctgggctgccttctgctcatctcagtgctgtgagaccctgggtgggagctggtgccttgggtggccgtgtgcgtgtgctgctccttgtggtgcctgaggagaggtggcctgtg

SEQ ID NO: 9387 - DNA, 1120 bp, Homo sapiens; identical to SEQ ID NO: 9386

SEQ ID NO: 9388 - DNA, 1120 bp, Homo sapiens; identical to SEQ ID NO: 9386

SEQ ID NO: 9389 - DNA, 1120 bp, Homo sapiens; identical to SEQ ID NO: 9386

SEQ ID NO: 9390 - DNA, 1135 bp, Homo sapiens
cgtgcaagcgcctcaaaccaagtcacgcttggcgaggccccagtgacactgatgtgctgagccaccatttcagactgagtctgcaccctcagccacatgaacaatctcccctacctccctgggactctgcttctgtaactgtctcattcacacctgcctggctcactggaaatcctcttttgagcgcgggatatggcttgcccttgtccgtgtgcccccaggactttgcctctacagcattttcttacaccccctccccagcgtgccctcagccaagtgctttggcccggtgcttcccgcagctgcacagagaccttggccacgcccgcgcgccctgagcgcagctgggttccaggagactctcagctcagctgagctagttgcctggcacccacctgtcgcgcgcggagagggggttccctgttgcttttgtgtctgtttcctgtccctggtaggggaagtgatgtcgtggatggggaggggtgggcagggtagtttcccccgcttgttttgggtgcacaggagccccactgctgatgacgaactatctctaactggtcttgaccacgagctagttctgaattgcaggggcctcaaagcagcacctaaaccttgagggggagggtgctctgggtttccgtgaggtaaccaccttaaatgggagggaagttggggtgtctgctttgggaccagaggaagatagcttgagaggcattggcgaggttcgcagcgccccagggagagagaaaaagctgagactcctggggaatgacgttggggtgatggagtccggggaaagagaggtggggggagagcctgaggtccccaagtgaggggagtcctaggcagagctgctgattgtggggctgggaggtggagggcccctgattcgaaggccatttggtgagtgttttgctggaaatatttcctgtatataaacttctttcaatctacaataataaaggcttgaggtaaactgctttctggttgcctttggtccctttattttcttttccctctgaatagcggcaggaattaaacacaaatccctccctcgcgtccccatagtgaccttgggaagcgggacgggaaggagcctaggctggcaggggcgctggaggaggatggaggagga

SEQ ID NO: 9391 - DNA, 1157 bp, Homo sapiens
taggtgctttatgaaggtatatgctatatgccttttttttttttttttttggtcttttgatctttcattaaaactgctaagatttcttctccccagagctttcttgctaatgtgcctatatcctcttactttagctatattccttatacaaaggagcatcagtgtgtatatatcatttatttctatttttagtgggaagatcctggctgtaaggatgaataatgttaagtttaaacctgaaaaatctcagtagttcaaagataccaaaatcactactatgtgaaatgtgtgttttgaaagcagtttgccagccgtgtgagacctgcggtgtggcctgcagtgcctgagtatgatgccccacttgtctttttgtattttttctagtgctactgtctaagagctggagctacagagcttgaaattaccactgaaaacactgaaatgttgggcccttcactgcttcctcataaggataccagaggcaacctggcatattaagcttgacacttggcagatcactgtgtaaattgtttttcaggaatacaagttgggacacttctgttcatttgacctttgagttgacccttaaattttattattgttttttttcccctcagtcttcagctcactgcttcacttctagttccacccacttaccaaatatgattgactcatgcaggtgaattaaaccattattgcacactttttccctctcctctctctcagtattactcttaacttgaatattttaacctgaacaatttaaataggcttgacattcccatgctgctttcaagcctttttttttttttttttgagacagagtttcactcttgttccctggctggagtgcaatggcacagtctcggctcactgcaacctccacctcccgggttcaagtgatcctcttgcctcagcctcccaagtagctgggattacaggctcctgccaccatgcccagctaattttttttttttttttttttttttgtatttttagtagagacggagttttaccttgttggccaggctagtctcgaactcgtgacctcaggtgatccgtctgcctcagcatcccaaagtgctgggattacaggcgttagccaccatgcagcccctttcaagccttttaacatcatgtcaccttcacaatgagca

SEQ ID NO: 9392 - DNA, 1124 bp, Homo sapiens
ttctctaaaaaaaaaaataaaataaaaataaaaataaaaaaaaattaagtagtcagtggaatcatctaaactggtctctgggaccatgagagctgagagcatccggagcccacctaaccctgagccttcctcttgccttggtcagtttccttctttgtttttcaaatctttttttaaaagccattttcaagtaatcaattaatatgtgaatacggccccatttacattttttcttcattgcaaataaaactgaaattttccctaaccttatcccctgagattggtctaccatccccacatctcaaagtgactgctgcctggagtttgctgtgtgtcattccagaccattttctccctgtggggggtgggtgggtgggtgtgtgtgtgtgtgtgtgtgtgtgtgtgtgtatttatccacataaataatataaatatgtatttattcacagagtatatagcattttttgtttcatttctttaaaaaattgacatgagagcagttttagtaacaaaaaccttttatacgtttttaggatcttggtggcgctctcggttcataatgctctgagttggtgttacgtcatattatcctgtattgtactgtgtatacatacgttacgtaaatgcttaatgtggtctcgcatgtttttctgtgaatttggcttaaactttcagactaggcatctaggaggtggcggcaagtggaaggtggagctgtcacagacactcggcccccgcagcctgtgcataggtgctctaggctaattttacaggtgtgatgaccgggccagagtgaaaccatgttgtctgattttagaacagaggtcacttatgcttcaccaagctgctggaaatgtggaattttgtttctcaattattggacctggtcctgaggagatgtttccctttagagaacatcattgacgcttttaagagtattttactagatgttgaaaacgttgaggtcttattaatgtagtgaccccaccaccaccaccccctgccccccccccacacacacacatcccttgctaaattattacatcaaatcatacaggaatctggcgctatcagagccagggttaaggcctaatagtgtcactagttactgagcttcttgatta

SEQ ID NO: 9393 - DNA, 1175 bp, Homo sapiens
gtatttggttggctctgcgccttggcattgtgggacactcctaggcgacaggctgcaaatcccccctgcagagttgggtcatggcttggtttgtggcatctgtgccctgtagtccctgaacagtgtactataactgatgacatcagccatggagatcattttgtttaaatgccgtttaagggtgtagtctgtgggtttcaccaaataaaataattaccatcaccatttatcattgaattaagccatgtaatttagcattaattctgtagatatgtggctttgagaggctaatatttgcataccaataaagattcaatttctggtatattttaaccgccattcaataaaatctcatgttatttgactcattgttttttttcctcctagcttgtttatgaatttttcttaagatttttagagtctccagatttccaacctaatatagcgaagaaatatattgatcagaagtttgtattgcaggtaaggtacaaattagctgacactctgaaagccctgatggaatgatgacacccagccactaagtgtctttttcttctcaaagcttttagagctctttgacagtgaagatcctcgggagagagattttcttaaaaccacccttcacagaatctatgggaaattcctaggcttgagagcttacatcagaaaacagataaataatatattttataggtaagtcacgtgtggatggcgttgtccttgtgtgtggtgatgctcatttcccccctcgatgctcccctaccccatcgtctcctctgacaggactcagcatgtggagggggtttctcaaagcctatttgtcatgtgcaggtggacccccttgtgcactgtgtgcagggggctgctgggctcatcctccctgccttcctcccctctccccacagctccctcctgagccaccaagctccccagcgcctcatcctgggtccctccattgttcctgtttctactgaaaggtcaagtttcctggaaatgtggatgaattggttccatccagaccaactgtattagtgaaggttctctagaaggacaggacgcataggatagatgaatatatgaaggggagtttattaggagagttgactcacacgatcacaaggtgaagacccacaataggctgtctgcaggccgagtcccaaaacctcaaaagtagg

SEQ ID NO: 9394 - DNA, 1421 bp, Homo sapiens
cccaggtctcctggctcttaagacgtttcctttttaatattataggaatgggaatgctggctccttttacagtactggtccctttacactgtactgcatactcgttttttcagtggatatatgagcttcttgtcaaaattatgtgggtcccatgaagaaacatctaaccaggggaagggggaaggattgagacataagacgtacttatataagatttcttttaagaattccaatcttggacatgttaaatttttttatattttctcatgtttaaatctcagttcgtttttcatgctgtgctcagcacgtaagtgtggggaaatggagcaggggggctgcgggaggagccgctggctgggctcaacatgcctgtgccttttccccttcagtgtgttcttgtgtctgatgcatctctaacacagatgacattttactgtttttcagagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgtaaccctccttttgtacaagtacttattttgccccatatcgttttaccacagaattgacttttttcctctgctttttaaataagatctgaatcttatgcatatactgtggtaaaaagaaaacttgaatacagcctgagactgtgcctcctctctcagatatcatagatgctgtcactcaaacagcatttccctttctttttcatatgaaattagttctaaaagaaaggaaattagattggaaatagattaagtatgacgttttgatgtcctctttctttgtatgaggtttctgtaagcccagccttttatcattaaaaatcagctgaattctgccacattagcagccaaccctccttcccaccccagcagcgggtgccagtgtgctctggtgagtctgcgccgatggccggacgtcccggagctgccggcagttccagctgccggggctgccagggtccgggagggtttcctggtgtcatggtctttgggtttgatgtacgctgctgtaaatgactagagcgttatgacagtttcttcacgttctgtgtgcctgattataacagtgcctcttaaaaagaaaatctttttcagaaaatcttttgtctgaatctttgccactcttaagaattctcaagctttccttcaactctccagaaaagattttaccgaacaatgtatttcttttagtgagagatatgcatagttacctaagttggtttttagatttctctgacacttaataaaaagttataca

SEQ ID NO: 9395 - DNA, 2676 bp, Homo sapiens
ccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctcatcatgaaactaaatttagccatggtgttgagcaagctggctctgacgttatcgggttcccgttaggtcagggccgcccacacacagggacgctgactgcagaggggctggccatctccatccagcccgcctggagcgctggctgcgccagatgctagccacagctgttcaaagctaagtctatccactgatttt

SEQ ID NO: 9396 - DNA, 1223 bp, Homo sapiens
aggctgaggcaggagaatcgcttgaacctgggaggtggaggttgcagtgagccgagatcaccccactgcactccagcttgggcgacagagcaaaactccgtctcaaaaaaataaaataatagaaataaagtgcacaataaatgtaatgtgctcgaatcacctagaaactacccacccccccaccaccccccaaccatctgtggaaaaatcgtcttccacgaaactggtccctgttgccaaaaatgttgagggccactgatatagaaagcaaagcaaagcatggtaaattctctgaggctgccaccttcagcctttagagtatgtaggaattgactcatactcttaaataagcaaaaatggagcgccactagggttatcctgttaataacgtgttgttttttcaaatatgaatagtttttgtctcgctagatattttgcaacatcaaaatgttccattgtaatggcatattttagtttacttagttttgttactttatgtgaaaaccattaactctttctctgttaatataggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagtaagtttgaatatataagacaaccaacctcaagacattgagatgaaaatatgtcttaataataagcctcacttttgaaattatatcctaggttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtaagatttgcattctaaaagtttgtgttttgtttttgtttttgttttgttttttgtttggtgttttttttttgttgttgttgttgagatgaagtttcact

SEQ ID NO: 9397 - DNA, 1104 bp, Homo sapiens
gaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtatgctctcatgtaatcctcaggtgtcctggtaacgaatgaagcacagtaatagcg

SEQ ID NO: 9398 - DNA, 1174 bp, Homo sapiens
ccgggttcaagcgattctcctgcctcagcctccctagtagctgggattacaggcatgtgccaccacgcccggctaattttgtatttttagtagagacagggtttctccatattggtcaggctggtctcgaactcccgacctcaagtgatctgctcgcccggcctcccaaagtgctgggattacaggcatgagccaccgcgcctggcctgaaaccattttttaaagaaatatttcaccatttaaagaaatgttggcaagctaaatagcatcttatgtttctctcgacagcttcgacaaaatttggatgccctcctgaaccagctgaaaagcttccctgcccggttgcgacagtatgcgtcctatgagtttgttcagaggcttctgaaaggttacatgaaggtaggtggccagtatcgcacggtgatgagtgtccattagaaacgcacctgcacagatcactttgtttactttctccacagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcaggcgagtaataggactgaacggctgctttacgttgtgtttcgggctgttacatagatctgagctatgtaaaaatggagccttgtcatctgtggtccttttggttcttataatgctgggtcccttgtgcaggtagtgaatgcccacatattgataacatgcatctttctggtttgaattcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtgctgttgctggggaagctttccctccccaccagtggtctcccacgctttcactgtaatgccttttcactgacagttactaggtacctgttttttattgtattttttgagacagggtctcactctgtctcccacgctggagtgcagtggcaccatca

SEQ ID NO: 9399 - DNA, 2573 bp, Homo sapiens
tacaaaaaaaaattagccgggcgtggtggtgggcgcctgtagtcccagctacttaggaggctcaggcaggagaatggcgtgaacccgggaggcggagcttgcagtgagccgagatcgtgccactgcactccagcctgggcgacagagcaagactccgtctcaaaaataaataaataaataaataaataaagtaacttactaaggcaaatgacatgaaattctttgcattcattgaattcctcttcaagatcttgttaggtaagtgtgtatcttttgccaagggctagaagaaattctgatgtgatctgaatttgggctggagattgccaccaccagacacatgttctttcccttcctgcagtttgaaatcttaccttgattcaccttatatgtgtatataatatttttgcaacttgagtgttattttaattttaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggtaaatttatgttcgtaacttttaaaacttctctcacatttttgcatacctcatttcttaaaattgtatttatttcaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggtaatctatagtagaagtgagtgggctcgtggtgaaaacgcagaccaatctttaaaatgatcctttgggatcttgtttctgtgtctttcaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttggttagtctcacacctgactccttccttaccagttagactcttacaccctcaaccacacagttaaatggaaatcatgcttgaaaaaggtttcaggtagtatcaaggagaacagtggatggtgtatggatatcctctgagggtgggcatttggctccctgtccctgttgaaaggtaatctcaggggcatgcaggggttacgcgacatcacggtagagaggaagggatcaaccttggtcaggatctcttgctctttcctgtcatctccccagagaggtggccacagcagtgctaagctgcacggcacgggcagtgcttgctgcgagccccatggcggcacgtggcagactcctaggatagacgtcagaaagctagtcttccatgatgttttagaatggttgcagaattttaaaatatttaaagccaggtgtttctgtttctttgtttttgctgcagctctgggttctgtgtaataccatctcatgagtaacatttctctcatctctgaaagtgaatttgccttttggaacatttactgaaagccattgtaactggacctagaacctcaatttcagtttaacagtccacaaacccggagaatgcactgtattgctttagtgtagatgaacttttaaagtgactctctttcttcagattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggtaagttcttccacagatctggacagatggaatcatatattaaaatgtttaaagataaagctaatgatttgaatgtacttctttttgagatggagtgtctgtcgcccaggctggagcacagtggtgcgatcttggctcactgcaagctccacctcccgggttcaagccattctcctgcctcagcctcctgagtagctgggattacaggcacacgccatcacaccaggctaatttttgtatttttcatagagacagggtttcaccatgttggccaggctggtctcgaactcctgacctggtgaccccctcaccttggcctcccaaagtgctgggattacaggcatgagtcaccacgcccggcctgaatgtacttcttaattatgtggtgtgtacattctaaaatcttaaatttgtttgcatttattactactttgatttttttttttttgagatggagtcttgctctgtctcccaggctggagttc

SEQ ID NO: 9400 - DNA, 1126 bp, Homo sapiens
aagcagattgtcagagtcagggtttgagccccgtgaagccagcactgaggcaggtggtatggtagtctgctcaggccaccatatccaagcagcacaggctgtgtggcttaacaatagaaatgtatttcctcacagttctggaggctggggagtccaagatcaaggtgccagcggggttcagttcccagtgagggccctcttcctggcttgcacgtggctattttgtcgccacaaggcctttcctcgggatacatgcagggagagcgctctggttcctcctcctcttcttagaagggcaccagtcctgtggatcagcggccccaacccttatggcctcatttaaccttagttatgtccttacacgctctttcgctaaagacaaacccactagggttagggcatcaacatactgatttgtggcaagggagaggggagacaattgagggcacagcaggtggttttagcgcctttcttcctctcctttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagagtaagacacctcttcttcaaaaattacttagagaatgtagagggaaattccctagtgaactaattttctacctcttggattagaaataagcaagaatttagctcacaggagctcactgttacaggcagtgtagtgagctgtggttaaagacggaaggtaagaaacccaggccaggcgtagtggctcacgtgtgtaatcccagcactttgggaggctgaggcggacagatcacttgaggtcaggagttcaagaccagtctggccaacgtggtgaaacccatctctactgaaaatataaaaattagcctgacatggtggtgcacgcctataatcccagctattcggaaggctgaggcagggagagtcccttgaacccaggaggcagaggttgtagtgaactgagatcatgccactgcactccagcctaggcaacagagcaaaactgttcccccaaaaaaagaaacccaggactgtattgc

SEQ ID NO: 9401 - DNA, 1100 bp, Homo sapiens
agtgcaggcaatgtgaagagagagagaatccagaagataaagagggagaaagaggaacgaggggaagcagttgatgaaggagaaattgctgaaaatctccctgaacaagaggttcgttacaaacgttttgatcactcaaaccttatacgttatttaaatttacctttttaacatttaagccatgacttgtgagttcttcttgcagttcacatgtcttgggatggctgaaatagactgtaatgttgacccagtgagtcgagtgcacgaatgtgggcgagtggtgctcgcaccctttgttcaccaacagttactgatcacgcacctcctggggatgcagcgggcagtacttgagccatgctgcgctgctcacagcccagccctctccccgtagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggtaacttggattgtttcactggccactgccctcacagaccctgctggctttagtgtctggtaatgacaaccgtgggcccttcgatgaaactgtccacaaaggctgtggaggtgcataatatgctttatgaagatttgcccaaggcctatttgaatttttgttgttgttgtttaaatgaagaggaaacaatacttaacctgaaaattttacatgatacagttcaatttctgaaaatgctaagtgcatgactatattggaaagttgtttatactgataaaaattctgcttaccagactttccagtgccagagatgaacaacctgaatcgctgatcaatacgtagtttacattctgtattggcttctttccttcctctatgtgattcatttaagaaaaagtttattgtttacacaagctgtgtgtgtttggcctgagagatgctgtacgggattgaacacatagctcatccattgggtctcttgttgtcctcggcggga

SEQ ID NO: 9402 - DNA, 1367 bp, Homo sapiens
ttccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgagcatgcagctaccacccgtgtttctgattctcgccttgttgatttaactcatcctggaacaagctgaccatggaccttggcttcgtcttttcattttattccatttcatagaaggactttatccttttagttccatgtgttagcaaagagtgcagattaacctgaccaattacttccttgttctgaaagttcaagtttgtgttcaggtaaacaaacctcgtgaggaggcaccttggttgcagccggactcacacttccatctccgtgtgtaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtaaagaggccaggaggtgggcagcagaccttttggtgctgagcatggggttggtcttacagtgtggttttgtgtcttccctccaaaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacaggtttgtttctatccacaaggcccttcctgccccacaatgtttcttgttcaagttttgctcttaatgtggtacctgtcccttccttcagatggtggagcacggaggcttttaccgtacctcagatcaaacatgggtgaagctggagagaatccagtttgttggggcttgtaatccccccacagaccctggaagaaagcccctctcacacaggtaaaacagctcggtagactgctctgcttcacacacgcacagctccaggattgctgtaaacacagcgccacaaaaacctggttttgataataaagacaacaatactgcttattgtggattcctcttgggttacttctctgtgctgtaatgccaggaaaacatgttaaaaataaaagcattggccgggcgcagtggc

SEQ ID NO: 9403 - DNA, 1581 bp, Homo sapiens
gagtaagtgtgtgtgccgggtcacaccaggcctcatgctgtcctaccacctccacctcagccttctccaccaagcagcttcccccttctcttctttctaagtccagcttaaccatcctcagtttatcctaagcagaacttcattcttcctcccccagcactgcatacctgccataattatggccctttgaccttctgctggaattgcattagtctctcatgtcagtctagaggacaggaccgtgtcttactggtctttgcattcctcctggacttcacaaataacagttgctcagcaaatgtttaatatacaagttcaagttaaaacatgtccaaaatactgtagacactagatatgagtcaaaaggggaatgaggcattataagccttaacattgatcagttctcgtaatgtttcagaatattccgtcaacctcaaggccacttgcttctgattggtgttagtggagcaggaaaaactaccctgtctcgtttcgtcgcctggatgaacggtttgagtgtgtaccagattaaggtgcgtctggtcggtggcctcttaatcccagcaacagatgtgtgtgcagagctcagtgagtaggaatggacctaacttgcctctgcttctgtaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtaattaggtgacgtgttgcgttgcattacgtgttaccgggggaccagtaagtcagcactgtgctgtttcccaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtacgtgggcctttacttggctctgggtcaggaaagtcggtgtccttccaagggacaaagcctgcccctcatagctgtcctgaaacatgggcctctttctcaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggtgggttcagttttgagatcaacagataaaccacaaaactaaccatcatgctaatataaaactaaattgctataaaaatagaccttaaggccaggtgcagtgactcatgcctgtaatcccagcactttgggaggccaaggcgggaggatcacttgaacccaggagttcaagaccagcctgggcaacatggcgaga

SEQ ID NO: 9404 - DNA, 2109 bp, Homo sapiens
actaaaaataggaaattagctgggcgtggtggtgcatacctgtaatcccagctgctcaggaggctgaggcaggagaatcactagaacctgggaggcagaggttgcagtgagctgagatcgcaccactgcactccagcctaggcgacagagctagactcagtctcaaataaatagtaaatatattcttaatctttatggggataaagaaattaggacttgtgagacattttaaaggtaatatcctgctttttaaggaatgctagcattttgtaagatcttcataatcatttaagagatcagctacttaccctattccagagggtttaatacagaaaagtctctcatttcttagctcttctaagcagctagctgtcctttctctcattggagttggagctcctggctgttttggttcattctcaccatgctttgctctatcttctcccacccatcgaccctcatccactcctgctgccactcagctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcaggtgagaaagtggaagtgccaaggtattgccagaaattgaaatcagttgttcaggccaggcacggtggctcacgcctccaatcccagaactttcggctgttcaggccaggcacagtggctcacggctccaatcccagaactttgggaggctgaggcaggtgaagtgcttgagcctaggagttagagaccaacctgggctacatggcgacaccctgtctctacaaaaaaatacaaaaatgagctgggcggggtggcatgcgcctgtagtcctagctacttgggaggctgaggtgggaggattgcctgaacccaggggatcaaggcttcagtgaaccgagatcacaccaccgcactccagcctgggtgacagagaaaaaccctgtctcattaaaaaagaagaaagaaaaaaattgttcaagtgttgagcacattttcagctttcacctgagaaccaagggtcagtctagctcatccccagtggtcagtcactggggcaatgagatgggagctggctctggtctcttccattttaattttatgaaaactcttccttgcttttgtcctgcatgtgtttagaaatatcattcgtcttttacagtgacgccataagggagaagatgaagaaaaattacatgtccaatccaagttacaattatgaaattgtgaatcgggcttccctggcttgcggccctatggtgaaatgggcaattgcacaggtgattaacacagccaggagctcccgtgtgaaaggtgacctcttttcctgtcacttaaataacagttatcaattggttcttcccagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaagattatcatcattgatcctcagcctttcctgctgtggaagcagagattaacacacttcaacatgcgctgcatgcaccatgctggcctcggtgaattcgctctttaacatctgtaaggccccggaggacttttttcctggaaaataatacacactgagtagtcactaagtgttgttaattaggatagattgatacaaactggacacttttcagccgttgaatcccccaccagcagctccagacctgtttgctctgctgcctgagggcctcgctccgtacccagcttctgccccgctgagattctgagtcgtgtgtggtcattagttatatatgatctgggtctcatctcctctgggactgtgaacaacttgggcacgtttctaacccacccaaaaccctgcacataatgtg

SEQ ID NO: 9405 - DNA, 1202 bp, Homo sapiens
taacgttttaactggctagaccgtaggtagatcacattagcttatttgtgtcctttcctcatttgtagaatggttcgataacagtgtcagcctcatagggctgttatgaggattacgtgacgtagtgtctgtaatttgacacggtccttggcaattaaaattctgtataatgttaatcccttgctgctgcgacatcattgatgttgatacgtgctgtctagaaggatcgtaaacatgaaaaagctattctaacagtgcaggatgctgagaggatgattgtcccagaaggaaaaagatttttaactatggccctcttggtgtatgactcaagctacctcctcatgccaatagttgttcaaaaggatgaggtgatgttagcattaagcatgtaagctttattggtaaacctgaaaacgtctccggaaaccactctcgggtggtggtaacagcctatcaatcagggtctctcatcagggactcggctaaccgtgatcctgtgctttccccattcggtgtttcaaccttctcttctgtggcctcatcctcaggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggttggtgttggcctttgaattcttgaaacactgcattcaagagtgaattcctttttgggggctgcctttagttttcaactttgtaagacttcattttgtatcagaaggataaagctttgcggtggttctgtaatagataaattcaacagaatcattatttgcatttaaaattctattcagtggtcgggcgaggtggctcacacctgtaatctcagcactttgggaggccgaggcgggtggatcatctaaggtcaggaattcaagaaaagcctggctaaaccccatctctacaaaaaatacaaaaattagctggttgaggtggctggcacctgtagtcccagctactcgggaggctgaggcaggagaatcacttgaacccgggaggcggaggttgcagtgagccgagatcatgccactgcactccagcctgggagacagaaagagactgtatcttaaaaaaaaaaaaaattatattcagtacagccataaaaagcaagaaa

SEQ ID NO: 9406 - DNA, 1101 bp, Homo sapiens
gactaggatgttccacgtttgtggcaaacacttctgagagcataccttttgaaggattattgcaaactctggatgttttattcatttaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcaggtgggtgccttggccatgcagagactggcgggccccgcacagtagctccttggccgcacagaggctggcgggccctgcacagtagctccttggccacgcagaagttcagcggggtgccgagggagctgcctcaccgctgcccactgcttcctttcagatacacttcttgtaccagtactccctccagtttttcctggacatttatcacaacgtcctatacgagaacccgaacctgaagggtgtcaccgaccacacacagcgcctgtccattataacaaaggacctcttccaggtagagtgaggtcctcagccgctccctggcgggggggaagcagggtgctgcttctcttatggaacaacatcgtctcctgctcttgtcccaggtggcgtttaaccgagtggctcgaggcatgctgcatcaggaccacattacctttgccatgctgctggcaagaatcaaactgaagggcaccgtggggtaagagcactcacgcccacaggaggatgccatattgctggtggcccccaagggtttcatgatcagatacatgcttttattatttcttttattttctcttttattttctttattttattttttgagacggagtctccctttgttgcctaggctggagtgccgtggtgtaatctcacctcactgcaacctccacctcccaggttcaagcaattctcctgcttcagtctccgaagtagctaggactataggcgcaggccaccacatctggctaattttttt

SEQ ID NO: 9407 - DNA, 1099 bp, Homo sapiens
tccatgcttccacccagcacccacccctctgtacctgtttcagcacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtaatgtcctggtacagcccgggcttcccacgagactccatgcccacctccccagccacaggtggcagcagccctggcatctgctctcactccgggctacagtctcctcctaagaccaggaactcgctgcagattctcaactcctggctgcatggtgcccacacctctgggcccagaaagaacatcttctcaggcccctcactcggggctctcctttcccttgacaggtacacactatttgctggcactgtaataacttctgccttctttgtttgcaggtgaagcccaacactcctgtcttaatgtgctctgtgcctggttatgatgccagtggacatgtcgaggaccttgcagccgagcagaacacgcagatcacttcaattgcaatcggtaaggatgcttgaggggcttcatgggctggagccctgcaggatttgtggtgggcattgatgtccgaggctgccgctgctaacactaagtttccctgcaccaggctctgcagaaggctttaaccaagcagataaggcaataaacaccgctgtaaagtcgggcaggtaggcctgttctctttggctgaagaaagccttagtccccaggcattcaggcaggcagcctggcatgctgtgtgactctcactttgtgtgtgcaggtgggtgatgctgaagaatgtgcatctggccccagggtggctgatgcagctggagaagaagttgcattccctgcagccgcatgcctgcttccgactcttcctcaccatggagatcaaccccaaggtgggtggttgaaggagtggagacgttgcaggctggcctggcactgtgctgtcggcacgtgtgtggtggaattgaacaggcgccctcatccacacccgagcataactggaacggcgctctcc

SEQ ID NO: 9408 - DNA, 1501 bp, Homo sapiens
ggcaatctcctctcccccagcacaggcccccaagaccaaacagagccctcccaggcgccaagtgaagaccgaaactcttgggcgagaggagggggattgtggcaggggtttcgttctgtcaattctgttctattttgtgccacattcacgttttctgacattcttagaaactctgtcttctctagatttcttactggctgaataaattctgatggtctcattggatgacacgtctattaatagaaaagttggcatacttttctcctagcagcagtactcatgtgaatctgctgccatcgtcaggatgtggagagctctttgtaaagctttgactgacctggcatctgcactgttcttggcgaagtgctgttttctaatgactctgtgcttggtcactttcctcaccagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagtgtgggccatgccaggacagacagtggacgtgtatctgggaaggatgctgcagggcgtggtgctgagaggccagactctgcgtggaagagcgagctgacccctcgtgaccgccaaagcctagctggccatggggagtgaggaggaaagctgtgcccctcgaaaggaagccccgggcctgcccgcctctgaccacacacacgaaccctgcttttcctcccccagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggtatgctgctgcctgctggaatggagacagttgtgatgtcagggcgtctggtgtcactcagaggtgacccctgacatcatttccaaatgcactggttttctaggcgagaggagtttgtgcagtgggtggagttgctccccgacacccagacgccctcctggctgggcctgcccaacaacgccgagagagtcctccttaccacacagggtaggcaacaaggatcctccccacacgcagggtgggtggcgagggtcccctcacgcggggtgggtggcgagggtccccacacgcagggtgagtgtgcactgctgtcccagggccctccctggttatgctgggtgtggctctgtcagcctcggccttcctgccagtctccagctgctcctagctccactccgaggggaggcagaggaaagaactggctcttctctgcagcatcaactcagttctagagaaaaggcttgatatttatgtaa

SEQ ID NO: 9409 - DNA, 1176 bp, Homo sapiens
aggtcaggagttcaagaccagcctggccagcatggtgaaaccctgtctctactaaaaatacaagaaaaaattagccaggcgcggtgccacatgcctgtaatcccagctacttgggagcctgagtcaggagaatcacttgaacccaggaggcagaggttgcagtgagccaaggtcacgccactgcactccagtctgggtgacagagcgagactccatctcaaaaatatatatatacacacacacacacatatatatatacatacacatacgtatatatatatacacatatatgtatatatacacgtgtgtgtgtgtgtgtgtgtgtatatatatatatatatatatatgtacacacggctgagcaccttccagattttgctgcagttcccagtgtggactcactcaccatgtggcctttacgttcaagtcccttttccctctgtgatttcttgcccgtcccctccctccttcctgctgcgactgtgggactgtggcccaggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggtagctgggagggtggcgggccggccaggtctcaaggtcccaggtgctgggtatggtcatggaccattgttccatggaccattggttccactgtgccggacggaacgtactcacaccggtgtcacctcagagcaggtgtccagctgagcccaggcattgggcaagatgagttggcccttttgaaatggactgaaaacaccctagaagattgtgagataggcagacagcgccacagcgagcagccgcagcccttcctccctagagagccccgagagctgcgactcgggcaggggcctcagcgggtttctgagcagcctcagcttcacacaagctcggttccaagtcacgctctgccaaagctgtccgtgaccctggacagttcggaagctctggggctctccccggaggccgagttacttctgtttgacctttacactggagaaaggacctcttcctaacttctct

SEQ ID NO: 9410 - DNA, 1394 bp, Homo sapiens
ccattgttcccagatacatgcacttagggtgaccggctggcagttgggtggagcctctgggcgccctgtgactggggtttgtgtagctgttgtgttcacctcagcctgggttttggcttccgcctcacaggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaggaggcactgcctttcccaggcattctgcagggacccctgcggtaacaagggcagaggcggctcctcttctatgcctgggttccacttggaacgggaaatgaggttcacagaggaaatccatttcgcacctgtccaaacctctccttgccgggccccatcagctgtcccgggcagtcttccagttttcttacttttcccttaagccaccagtaaacccctctgcttctgcaggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggccacagcactcatgaatgaagaccttggggcccttcacagacacagatgcagccagctgtggctctgaaggccctggggcccgggcaccatggttcacacctttaatcgcagcactttgggagtctgggagttaaagaccagcctcggcaacatagtgagaccccgtctctacaggaaattaaatcaggtgtggtggtgcatgcctgtagtcccagctacttgagggctgaggtgggaggatcacccaagcccaagaggtcgaggctgcagtgagctgtgatctcaccactgcactccagcctgggtgacagagcaagaccctgtctcaaaaaaaaaaaaagctgggcgtggtggctcatgcctgtaatcccagcactttgggaggccgaggcgggcggatcaccaa

SEQ ID NO: 9411 - DNA, 1453 bp, Homo sapiens
gatctacaggatgatcaaacttggtctgggtaagccttatactatgtaatgttaaaaagaaaataaacacacgtgacattgaagaaaatggtgaactttcagttatccaaacttggagcaccttgtcctgcttgctgcttggaggtattaaagtatgttttttttagggataagtaaggtcttacaagagcaaagaaatgaaattgagactcatatgtcctgtaatactgtcttgaaagcagatagaaaccaagagtattaccctaatagctggctttaagaaatctttgtaatatgaggattttattttggaaacaggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtgttaaatacagtcacttaattccttggccttacagtgtctcaaagttctttacaaatctacttaaagccatcctggctgaggc

SEQ ID NO: 9412 - DNA, 1150 bp, Homo sapiens
tgtagtggcaggctgaggcatgaaaacagcttgaacccccccgggaggcagaggttgcagtgagtggagattgcgccactgccctccagcctgggcaacagagtgagactgtctcaaaaatacgtcccatcatcttcaggttatctttgattttgggagtttacatagtaccagttttgtccttggaatgactcagtgcatttggtttatatttttttcagacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaaggttggtgtaaataaccattagttttccaattggcctctttagttttttttttttttttttaattcagaaagtctttgtaaagaacatactttgtttcagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtaagagaacactatgttacagtcatacacgtcgttcttacaatcttgtaggctctgtgggtgtgttttctactcaggtagcactgttacaactggtattgatctaggcaagataattaacatgaactaggtcattttctgtcttaggttctgcctaggtatctggctagcaagaaaagtcagagctagatgaaaccattcttaactgttaaaaggtctaaaagtaactttgtaatacctcaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacata

SEQ ID NO: 9413 - DNA, 2119 bp, Homo sapiens
gatccctgaagcagccagggccgcgctcccgggcggccgcgctttctattccggaggcctcgggaccgctgcggtttccgcaccccgcttcaggaatgggccgggcggccgcgggctccccgaggctctgcagcagcgccagagctggcgccgcacgcgaacagagcggccccgccgcgggggtcccccgcccggccccgctgggggcgcaggcggaggaggccgccgtggcggagccgcagcccgcgcgggagggcacccggggtgttcgttggggaccgcggcgggggactgggcccgggcctgcggcggcctcccggaagcgcgcacacgctcgtggtagttgccgcgctccgaaatgaggtcatcctttgtcagccgcccttctattttcggtttacttaaacttcgcaaatctccaattcggctttaaaaatatttggagaacgcgatggaatttcgtgttgcctctgtagacgtcctgcaaggttttaaaccggcgcggtgtcgttccagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgtaagtcacttattaacccagaatcggattttggtttcagtgtgaacttcttgggggtgctgtatgcttaaattaatattttttgttaacaggcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtaggcacctgaacattcactggttaagtgagcggtggaagggtggggtgctgcaacccttggacccctggggatgcggtgaagcttacagaatttgtgtttgcccaacgatcaggaacaagctagagcacttaattagtgtaatggcatgacttggtgggcggttcttttgggcgaggcaccttgcccaaaaggttctgctgtggtggcctttgcatctgtagtaacggcaaaccttgctttatagacacgttataagggtgttaggcatggcgttgagcactaaattgaatgtattaagtcaatttttctttcttctcttgcaggtgaacctatgggtcgtggaacaaaagttatcctacacctgaaagaagaccaaactgagtacttggaggaacgaagaataaaggagattgtgaagaaacattctcagtttattggatatcccattactctttttgtaagtttttatgtaattgcagagtgaatttctgtctgtaggtgattggggtgactgtactacatccttagtccctagatctgttcaactagtctgaagcctggggaacctaagctctactacctaactctgtaaaagttcctcgggctattaagtggatgtatcaaatattgatgaaaagctgggtgcttctcaagttggctaatttagacttgggccttaggttgaaaatagtggtgcagcgctgtcgcttagttctggagtgcagcagtgatgtgatttcgtgttttcttttgaaggtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagccca

SEQ ID NO: 9414 - DNA, 1249 bp, Homo sapiens
tttttttgttgttgtttcttttgagatggagtctgactttgtcgcccaggctggaatgcaatgacgtgatcttggctcactgcacacagccaccgcctcctgggttcaagtgattctcctgcctcagcctccagagcagctgggattacaggttcgcactaccatgcccagctaatttttgtatttttagtagagacagggtttcaccatgttggccaggctggtctcgaactcctgacctaaagtgatccaccctcctcggcctcccaaagtgctgggattacaggcgtgagccgccgcgcctggccacagtgcagcttcttaatacgggagtgaaggtttttaatgtgttttgtcattgcagtaacatttatttttaatggtgctataaatgctgttcatacctcactattgcaaagcaatactgtttttacttgatcatactagtttttgagttctcatgcagttttttgttgtgttttttaaggcccaaaataaaatttactcctaaccgtgctgctagaagtttttatgtcctgaaatttctccacacatggtaaatagagtaacaatgaagtgatcctagaaaaactgggatttgatttggttctggtgaaatgtaaggtgcaggaattgggagccactgtaccaaaatcaggacagcagtctggcttcccaggcctgagttagctggtgtaggcctgcctgacaaggccagtgatggagcgagctgcagacacccttaggccctgggcgatcaggtacagttgtgtttgtgggatcaagagtgctggggtagtctgggcccagtgggcacagcaaggtctggcagagctgtgatgggggagtggaggcctcttaatccaccgttcaccatcccatcatccttgcacctccctccaccatcaaaaaaaagccctgctctggccatgtaaattatctctgtaaccccttgctgagaaaattgcacgaaggtctaatggaaatcctgccagagcagcgctgggttttaggttgttggcattagtgcaggtcaggtgctgtttataggtaggtcaccaggcaggaggataaagaggaggtgggggatgaaaatactggctgtgtccccaaggctggcttgccacgtgcctattaatttaagaggaccagccatgccgttttacggcagtaagcagtgacacctgctgctgagtaactgcccaatgcatggtccccagccctgggcccgcatgctgtgtggcgttca

SEQ ID NO: 9415 - DNA, 1245 bp, Homo sapiens
cctttgggcctccatctggccactctcctgctcttggcttttgtgttcttctcttagaacttcttaagctacattgggacaccagataattctgaattgttcagttttcaaagagtgtctaaaactgttttcagatagatgttacatttaggcagaatttaaccactttatgttgattaaacttgacaacaaaaaagcggccggacagggcagctcctgcctgtaatcccagcactttgggaggctgaggtgggaggatctcttgagcccaggagtttgagatcagcctgggcaacgtagaaaggccccgtctatatttttaattaattaattaattaaagtttttttttaaagcactcatcataaaagaatatagcaaaataccaaaaaaggaaaaataagccaataaccaagtcaaaatgaggtgtggagttctgactgtgtgtctttggggcttcttcccatcttcctggcaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcaggtactggcgggccagagactcctttcacatcgtgcttgtcctacccttcgttcttgtccacttgacaccacaaggcaccatgaggccgttcctgggaggcagcacctgcagcctccatggctataggctaagcttgaatctctgcctaattctgaccggcaaactggacgttgagtcagagctcgctttttaaaaatgctgccgccctctgcgcagccctgagcatcacagcgtcatgagtctgtcatgacggtctctattcagaattgcccaccgtcaggtagttctggtttagtgtctgtgacggcttaggtccaaatatttttctttattttcatgctaatcgaagttgatctctgaactgtagcttttttttttttttttgatacaggttctcactctgtcacccaggctggggtgcagtgccacgatcacggctcactgcagccttgacctccgggctcaggtgatcctcctgcctcagcctcctgagtagctgggactacagatgcatgccaccatgcccagctaatttttgtattttttgtagagatgagttttgggttttcatcatgttgcccagactca

SEQ ID NO: 9416 - DNA, 3459 bp, Homo sapiens
ttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcattttctgcacccccacgctccatcaaagcagtacccttccctgtaacaaagtggggttctttctttccttttaagtgaggcttggggtttccaaatgttgaatttcttccaaatca

SEQ ID NO: 9417 - DNA, 1191 bp, Homo sapiens
cactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccag

SEQ ID NO: 9418 - DNA, 1858 bp, Homo sapiens
cgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactccc

SEQ ID NO: 9419 - DNA, 2122 bp, Homo sapiens
acatgatgaatttgatctgtgaagcctcttaggtagcattgtgtgtgctgtgtggtttttctgaggggatccataggaaaataagggcagggttttaaacgttaatgatgggcaatgaggtaatgtaagttatggggttaaatttttatttccctttttttctgtagagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggtgagtgcagggttgatggcctagtgggcactaaagttgtgtaaagtatatggcatttggttgaggtgggtggaaatgttgaaactagccttcagtgtgtaatacactaatattgtggattccaagtactgtttgttgtttgaattaaggtgaacccaattttggatggagatggacttgatgccattaacttggcaaaatctgaacctttttgttgttgtttttaaggcctttgatcaagtagctctgttttcataaacaggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaaggtaaaacatttgcttggtctgtaaatcagcttcaacccagccttgtttgtgcctttagatatatgatactttagcagtgtaattaggattactctaatgcacgactttttagaactcttgttcatttaaatattttttgcgcgtgattccaggcactatgtgtcacaactgccaaattaggcaggaaaaatatgttcatcagagcagggactggctggtgtcttgagcctggcaaagtgtgcctccattgcactgaattgttttccttttctttgcagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgagtaagcaaagtgctctggattcataaatgagattacagttgtgtggctttcgagatggtcatattaaccacttttgcttgtcctgtcatgcttgaaagtggggaaattgacccaccttacaagcctctgagtatctgaaagtgccatacctaggcccttacaaagtaacagggatgtttatgcattgacctttttgaacaactatggtatgggccatgcacttgcagacactcttatttgggtaatagagttgtcaacttagaacacataaaaaagattgttaacaccaaggtgtctatttgcagttttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggtggggaatacataggtgggctcttaaagttcacaggttttggggggtttttttgtttggttgattgtttttggagacggagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttcacaagtattgagacggctttgagatgaagaaaaaatgtcttaatatctatagctaaagttcagtgcctgtgctgtagattgtgattcgcatcatgtcagatttgtagtcataacagactgctgagac

SEQ ID NO: 9420 - DNA, 1478 bp, Homo sapiens
agtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaag

SEQ ID NO: 9421 - DNA, 1139 bp, Homo sapiens
agcacattgttttgaattactgttagcagtgtagtatagaaggaaatcgggaatccagattctctatggatttccccctgaacagttatgtggctgtatccttatctagtgaatggtgacattagcttttcccctgctgcacgggctgtagtgaggctcaggtgtgcaggtgcacttactaacatatggaaaagttaagcactgtataaccagaaggtagcccttttactcctattttatatgacagccacgtatgcaaaatatctaatttcttcctgaacactcaattgaacttcaacacttcgtatttttcgtctcagaatttttattttcctcaaatttatattatgtggttaaattcctttgaagtgctagatactttaagattaaaattaaagtaggaatgttttttcttcaattagaagctcttagaacttggcaagtactctgtgttctctcatttccttatctttgtgtatgctgtattgcagcacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggtaaataccagttatgcttatttctgttatgacagttgctctgtttatttccatgtaagagaaagaaaagaatatagatataggccttatttcttttttttaagatggagtctcgctctgtcacccaggctggagtgcagtggcatgatctcagctcactgcaaactctgcctcccgggttcacaccattctcctgcctcagcctcccgagtagctggcagtacaggtgcccgccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttctaaccacataatataaatttgtaatacatagctgggattaca

SEQ ID NO: 9422 - DNA, 1884 bp, Homo sapiens
tgcctcccgagttcaagcaattctcctgcctcagcctcctgagtagctgggattacaggtgtgtaccaccacacccagctgatttttgtatttttagtaaagacagggtatcaccatgttggccaggctggtcttgaactcctggcctcagatgattcgtccacctcggcctcccaaagtgctgggatcataggtgtgagccaccgtgcccagcccccatattattattatcaattgaaaaactcaaggcttttcttgatcttgggacattgatgtttaaattagtgctagaattaatctgtacttcatgtttgttattgttaatattataaaataaggagttctgacttgtctcctgtttttttctctagaaagaatgttttcacattaattaggaggtaacttcatatcattacagaaagcttttctaaaatgcctaatcctgtcataattctaattctattttggctaaatttcatttttgtcttgatgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgttttgttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgtttttgtctaagtaacatatttctgttttgactcatgtctgtgcctaaaatgtgaataatggaaagttaagcacaagtcatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaatcccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgggaggtg

SEQ ID NO: 9423 - DNA, 1210 bp, Homo sapiens
gaactagctgaagtgtaagaggttgattttcctgtacgattaaaaataaacctgcctctatgcatttcagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaatcttgcattgtctcctaatgctgtatttaacacatcctcaagttgagcagaagtaatgtgtatgaaggcttggggccacgtggaccttcgcaggggtcccagcattttgtgattaccagcatattttttctcccaaggcaataaagagagaagatggccctcatggtgacccaagaaggaagggaatcca

SEQ ID NO: 9424 - DNA, 1214 bp, Homo sapiens
tcagggcctgtaggggtttcaggcaggccttctccctcataccctcttctccgtctgcagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggtgagcagggcaggtgctgcggcttcccgtggcctttgggcagccctgtttcctccgccctgacttgctgtctccccaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctgagtggtgcctctcctttcccaggggggagggggaagggcagcagccaggccccaggagtcttgagtcctgggcctgctgtgggcctcgccttctgtgagatgggacaagagccaggaggtggccactctgttctgcctgccctacctagtccatgggccccttccctcgtgtctatcgggctgtgcaggcaggaacatgggagagagcgagggaggagctccaggcctgagcatctgagggcattcaggcctgggtgtggagcctggcacgttcctcaggcccatcctgcagggtgggggaggtagggatagtggaggtggggggttgacctcagaaacttgagagctttccggtccctccaactggcttcctcctccagtcttccaagctgcaacactatcagatgcaggcatctccctgcctccttcctaccccgccaacacctactctctatcttctcttccctgcttccttccctcccagcctcggccttcaggctg

SEQ ID NO: 9425 - DNA, 1224 bp, Homo sapiens
cgcgtcgcctggagcgcgcgccggaccggccgggggtccccggcgatgatggcgctccccgcgcgcgctgcggaccccgctgaccttggccgcgtcccggggggcgccggggggcccggcggcgggggcctgagtggtacgcgggagcccgggaaccccggcgtgccggtcccctctgaccccgcgtctccccgcagcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggtacgcgacccctcggggccggggtcccggccccccctccccccgcgcagccgcagggtcctcagcagcgcgctcgggcccggcagtgacgtcactgtccccgtcccgcgccccctcccccaggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcaggtgcggggctgcgggcgggccgggcgggcggggccggggtcttcgggcgctcactcccgtctcgcctcccagggcggcgacgacctggaccccaactacgtgctgagctcgcgggtgcgcacgggccgcagcatccgtggcttctgcctccccccgcactgcagccgcggggagcgccgcgccatcgagaagctcgcggtggaaggtaggggccgggcgggccgaggggcggcggcggccgcgtccccctcccggcgcggtccccgcccgcttttgtttacgtcgcccgggagcggcagccgccgtcgcgctcttatctgcgcgcgcccgggttcagtttcccggagggaccgagggacggaggcccagccccgcgcccacagcggcctggggcccagggagggcgggtcctggcgcggggtcaccgcctgggaccgtcgcccgggccgtgaggactggacgcccgcagatccgggcgggtggggccctctgacgtcccccgaggtggggcacgggggcgggcgggtccgcgctgcgggctgga

SEQ ID NO: 9426 - DNA, 1237 bp, Homo sapiens
aggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccggcggctgtgagtcttctttctggacccagactgcgctgtggcacgagggttcaggtgatctggacacaggaaggcgaggccttgtccgtatgttcaaaatagtttttaatcataagctttatatacaaattgctgtacagtcatcttaataaagtgaaatagtgagtgaaaagtacaaaacacaaagcccccacgttccccttggtgaagtatcaaaggatcactcacagcccagaagccccaaattagtgacaaggtaagtggacaagtctgtgaaacaggctaaggcaagtgctgtaaactggctattagaggcgaacaggctccactgcagaccagaagcctgagttcctactgcccaaactggttctgtggaagaattaaatgaaatgaatattgatgggccagaaccttctagtagacctgcgaactcataaaaatggtatatattatgctaaaaatagtttagcagtagtgtagctcagtctc

SEQ ID NO: 9427 - DNA, 1197 bp, Homo sapiens
ttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaatttttggctcactttgctgggtggaagagtgggtggccagggagggagtggggagtcctgggagggaagcagcatcctcagagcagctggtcctccccagctcctcctggtgggcaccgccaccccaacaggtttggggacaggctgtgtggtgggccgaggcgggagtatacag

SEQ ID NO: 9428 - DNA, 1215 bp, Homo sapiens
acagatgggactttggtgcccttcatgcatcaggcctcagtttcccccttaggcccaggtgggctgggatgaacttcaccatggcagaggaggtctgggagaattgtgcctcagctctgtcatctctgtccttgtccccccatttctgcctccccctacctcggacaggatcctctttcagaacacagggagagcttgggaggacctggaagccaggatcaacgccgagaacgaggtgcccatcctgaagacatctaacaaggtgagcgctggggccccgtgccccttggcctgcccccagccagcctgcctttgcctggctggccccaaaccttgtcccagctcctgcacacagagccccggggcagggctgcagcccgtcagaagttgactccacctcccttcctgccacgtttccaggaaatcagctccatcctgaaggaactgaggcgggtgcagaaacagctggaaggtgagtgtggcccaagcctggggcagcaagggaggctggcagggccttgtggggaaccctgactcacagggtgggagcaggtgaactggatccgcagcctgaccctccctccccacctccagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccagg

SEQ ID NO: 9429 - DNA, 1227 bp, Homo sapiens
cctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttggccttgtttctctatccttggtgtttggggtgggtggggccctgcacataggacagaccaggggtggctgcaattcagagatgctgccaccaggaggcggcctgggctagaaagcagcatttccagatgtttactcctaaaaaacagaagagttaatttatgaaaactgttcagtgagacagcatccgagagcgctgtttttgtttgtttgtttgtttttgagacggagtctcactctgtcgcccaggctggagtgcagtggcgcgatctcggctcactgcaagctctgcctcctgggttcacgccattctcctgcctcagcctcccgagtagctgggactacagtcgcccgccaccacgcccggctaattttttgtatttttagtagagacggggtttcactgtgttagccaagatggtctcgatctcctgacctcatgatccgcccatctcggcctcccaaagtgctgggattacag

SEQ ID NO: 9430 - DNA, 1182 bp, Homo sapiens
caaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaatt

SEQ ID NO: 9431 - DNA, 2727 bp, Homo sapiens
agcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggcccccgcctgcagtgtgattctctcggccgtccaccccttggga

SEQ ID NO: 9432 - DNA, 1205 bp, Homo sapiens
gtggcagctttgggctctagggctggggacaccccgaccccaactcatgccttcctagtggctgcattgctcggccttcaggcctgcctgcctgtgatcttggcgccagcctggctgccccccctccaaccttcccatgcctcggtttccccatggtgtgggtgaggacctcgtctctcagccgtccttttgtgccctgtggcagctgtgctgtggctgatgaaagccaggaccctgccttgtcccatcccggaggtgcagctcccctgggccccacacaggcttgggaggagcccttcgtggggctgcgccgccctccccgaaccctctgtccccctgtgcccgcaggcccgtcccagggcctcactgacccacgcactccagtgctgtgagggtgggtggcctggactcctaggctgtggcggaggggccccaccatgcctggcagagatgctgctggtctcttttcctgtgatgaggagcatgggaggttgggtgctgtctgctggcagcacagccacgcgtgggatccagactgcttctgcgtgtgcagtccgtggtcactgtggccgggtgtgctcggagctgtcaggccccccacgtgcccgccccgaggacttcctctccctgcaggtgagactgtaggcctccccctctctactctgactgtccctataggagaagcggcatttatccctggcttctggaccggaaccctgggttccggcaggaccccggcagagccctgtggtcgcagtgggctgggcattgcaggttggcttcctgtcttggtgctcgctcggggaggtgggcgtctggattcttgagcccccagacaagaaagaggaaggtgtgcagtgtctcctgagcagcctttgtccgtctgtcgccggctgcctggcacgggctccatctgggtggccagtcctggcctgtgggagatgccggcagggacccagcctgggaaggggcttgctcctgtgcccccccaccccagggaccttgtgtgtagaggcaccaaatttagttaagaaaagtacaggacgcccaggcaaatttgagtttcagataaacagaaatttattagtgtaagtatgtcccaaatatggcatgggacatacttgtcccagaagattcttatctgacattcacagttatctgggcaacccgtattttagctggcaggctactccgaggccctgcca

SEQ ID NO: 9433 - DNA, 1291 bp, Homo sapiens
gaagtcctaccccaccaaagtgcgcctgatccgggggggctccctgcccccagtcaagcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaccggtccttccctgtgtcttttgttcccagtccctctccctgactcaggccctgggccccccacccccatcgggcggccctaggctgtggctctgccgtggagctggaggcccctggaggccacctcagccaggacagccaccccagcctctgggctctgttgctctcccacctgcccacagaccttcccctgctggggcctggcgcggtgccctctgccctccccagggggcagcaagcggttgcagggcccaacccccttccccagcagagctgtgctgaaaccgtctgtgcgtctgtgtctgcggcagcggtgggccggggactgcctcccggcaggcagagctggccctgccgaagaccctgtggcttcccaccagggcagccagtgcagctgggccagcgaggccttggagtgctccagccagagg

SEQ ID NO: 9434 - DNA, 1124 bp, Homo sapiens
gccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtctctgcttgtgggatggatgcaaatcccagaccagggtccctttctccggtccatgcgtgctcccagccaacacccctgggcctggctgctagtgggggtgggctcttctcctgggggtcatagtgggaggtggggccctgggatgtttctgagcaggagggagggatgggggcggggagcgtggtctccggtttgggtggtggtgcccacccagatggggaggcagtaagaacgccaggctgtggggaggtaaggaaggtgggaggcattccggggccagggtcctggccagggtcaggtgagggtggggtccatggaggacagagccttggagaaaagttgaacctagaaccctgaaaataccaacagcaggcctgagaacccggagctgcctgggtgtgtggaccctggcaagcgcaggaggggtccgccctgagagcagagtgtggctgagga

SEQ ID NO: 9435 - DNA, 1149 bp, Homo sapiens
caagtggctattcattaaatttctccatgaaactaccagatacagaatagataaattgtcactgtcttaaatcaacccttgggaaaggaaaactgtgtaaagacagcagagaggaaacattgttcaagggaaaaacaatctccagaaactgttgttaaagaaacagaggccctctttccagccagtgccgagcgatggacatctcttgggacaactggcacaagtgccacaaaaccagggacaagagaaagccctaccacaagaagcggaagtatgagttggggcacccagctgccaacaccaagactggcccccgccgcatccacacagtccgtgtgtggggaggtaacaagaaatactgtgccctgaggctggacgtgaggaatttctcctggggctcagaatgttgtgctcataaaacaacgatcatcgatgttgtctacaatgcatctaataacgagctggttcgtcccaagaccctggtgaagaattgcattgtgctcattgacagcacactgtaccgacagtggtacgagtcccactatgcgccgcccctgggctgcaagaagggagccaagctgactcctgaggaagaagagattttgaacaaaaagcgatctaaaaaaattcagaagaaatatcatgaaaggaaaaagaatgccaaaatcagcagtctcctgggggagcagttccagcagggcaagcttcttgcatgcattgcttcaaggccaggacagtgtggctgagcagatgggtatgtgctagagggcaaagagttggagttctatcttaggaaaatcaaggcccggaagggcaaataaatccttgttttgtcttcacccatgtaataaaggtgtttattgttttgttccaaaaaaaaaagagaaacagaggcatcacacttactagaaaaacatattctatttcatatattatggtggtatgacgtgatgttttgacatatgcaggcattgtgaaattattaaatcaagtaaataaacatgcccatcacctcacatacttattttttatggtgtaaacgtgtaaaatctactctattatcagttttcaagtatatagtacattagtaccatggaagtcaccctgctgtgcaatagatcttcaaactaattccttctgtcaaaccaa

SEQ ID NO: 9436 - DNA, 1149 bp, Homo sapiens; identical to SEQ ID NO: 9435

SEQ ID NO: 9437 - DNA, 1149 bp, Homo sapiens; identical to SEQ ID NO: 9435

SEQ ID NO: 9438 - DNA, 1211 bp, Homo sapiens
tgccttctctcagcacatccctgaataggctaaataaataaattagcatatgcttatgtgcacctattgctaagaagaaaatgtatgggtgagaaaattttgagtttctttgtatagattattcaaaaggacacatttgagaacctgataaatgtatttccaaactagatttgtatattatgcctaattttttctgcagaatttttttttcttatcagaaagttttattaaggctagaaacatttttttttaaaatatgggatcagagtttatgaaatcagtttaaacttggttttatagcatgatcctatcttttgccataatttgaagaaatatacaggttggtgctaaatttaaataataaatattatcaatattagtaatgaaggagctattttttctttaggggaagagaaatggagtaaaattttgaattgcatgtgagctgtcatgagcattctgtgaaaaccacatttcattttttattgtttaggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtaggttatgccttatgtgactttgaagtgacctcagtgtctacctacatgcacaggttctttgtacaagaccacatcttcattcctcgtgagtgtatttgaaactttgaattgttcaagagttctaaatgtttacaaagttgatgtttggttatttatattgagaaaagaagtgagaagatgtcataattagttaactactcagtcctgcagttatcatcaaaatggaaacagggaccaatgcccaagtaatatccaaccttttctttaaattttgatatgtctgcagggaaggaaataagagtccatggttaggctgggcgtggtggctcatgcctgtaatcccagcactttgggaggctgaggcgggtggatcacctgaggtcaggagttcgagaccagcctggcaaacatggtgaaaccccatctctactgaaaatacaaaaattagccgggcatggtggcctggcctatagtcccagctac

SEQ ID NO: 9439 - DNA, 1442 bp, Homo sapiens
tttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaacaaaaataatttccttcccttaagtttctacattttatcaaaattaatagatgtcttgtgacatctattaatatacatataacatatttataatataaaagagtgagacattgtgctaagcccta

SEQ ID NO: 9440 - DNA, 1272 bp, Homo sapiens
gttctcgaaaatttaccaaatataggttggctgtaaaatcataactatctgaggtatctgtcaataaatcaaagattgcaatgatgatagcttctttaacatgaatgtaattctaacagtaaaaaatttctatatggaatatgttttgtagtcctaaattgatattttatatcatttttcagtgaacaagtagttgtttacaggtgtctgtgcatatgtctcaagtttttctaactaaaatattaatagttaagtctaaaaatatgaattatacgtggggcttgtcattctgacatttaatacttcagcgtggtgataatggtgatataatatactgtttgaaattgtaacacatgagttaaaatcaaaagattgataagtacatatttgtatattgctacatgacaaaaatctaggaagaatatgattcacatgaaaattctttggaaggacatgacagacttttaacagtcctgtatagtgaaaggagaatagaacgactacttctactttctgtatctgaaattttcaaaagctatttcaaaatgaacatttaaacaacaggaaattttagagacaaccactttgtgcctgtcttcatccttgacattcaacatcctaggaacaatgggctgttgtattcaacttcttattcccaacagccattatgaatggtttttgattgatctcacaaagagcatgtgctttagacattaatgcagcgactaccatgaaacagagtattggattacctaaggaaagaagcagaggatggaatttgaggtaggtgtcaaacagtgaaatttcgtttgagaaacagatgagtgaaagaaaatagtaactgaaacattcattctataaggagagtacattttaatactggcgatgctgtatttgtgggtactgactagatcaagatgttagaggaggtgtctcttgggataagttggaagttatccttcattaatttggtataaactgaaaacagattgcttctttccttttaaagtggttgagtctctgatgggtttaaagtaggcctttggggatttatagatcattcaaaattagcaggggaaattttaaatattctctgcatctttctaaaaggtgtggtttaaagttggtgagaaagtgaaatggttgctggttgaacttgattttctctattcactatgcctggctagcctaaaattatcctaatgggtatgttcaggtgcctgatttgtatctaaatgtttctgtattggatactgtttttcttaggcaatc

SEQ ID NO: 9441 - DNA, 1089 bp, Homo sapiens
ctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaa

SEQ ID NO: 9442 - DNA, 1130 bp, Homo sapiens
aggtgtaaaattgaatttttaagaatattcttgacagttttatgtatatggccttttcatagcttaatattggctataacagagaattgtgaaattgttaagaagtaggtgtaaaattgaatttttaagaatattcttgaatgtttttttcttggaaaaattaaaaagctatgcagcccaataacttgtgttttgtttgcatagcatattataagaagttcttgtgattaatgttttctacaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccgggtaagaaagcaggtgtctgcaaaaagtcatgtatcgatttattgtttgtaatgatacagtagtatagcagataactaagacatattttcttgaatttgcagaatctagatttccaagcactagaagaaactacagaatatgacggtggctataccagggactctgttctgattaggtgaggtacttagttcttcagaggaagatttgattcaccaaaggggtgtgtgattttgcttcagacctttatctctaggtactaattcccaaataagcaaactcacaaattgtcatctatatacttagatttgtatttgtaatataatcaccatttttcagagctaatcttgtgatttatttcatgaatgaagtgttgttatatataagtctcatgtaatctcctgcatttggcgtatggattatctagtattcctcactggttagagtatgcttactgctggttagaagataattaaaataaggctaccatgtctgcaatttttcctttcttttgaactctgcatttgtgaactgttacatggcttcccaggatcaagcactttttgagtgaaatggtagtcttttatttaattcttaagataatatgtccagatacatactagtatttccattttacaccctaaaaaactaagccctgaattctcacagaaagatgtagaggttcccagttctatctgcttttaagcaaatgcccttactactctactgtctac

SEQ ID NO: 9443 - DNA, 1188 bp, Homo sapiens
atgaaaataaatgttctcttttttcctctgattttctagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaa

SEQ ID NO: 9444 - DNA, 1140 bp, Homo sapiens
gtccgtatttgaaagatctcaatctgtgttctgaatctttactcatttacatatacttaaatcttgaaacccagtatagcaaaactaagccaaaacaaacaaaaaaatccatcccttgataggaagtcagtatatctgggttttagtcagtccttcaacactagttccaaaatcttgggcaagtcagttaatcactcggaggctgcttaattttttttttttttaattcttagtatattatctgtcttgattaggtaaagccaaagttgttataagactcaaggtactattgaccaaaatgcttcagaaactataacattacataaaagtacaaggaattattacattttctcaaatgaagagatcatttaagaaaaacaaaatgctggaaaatagtccttaaaaacttttctataataattactcttctgatgaattttacattgacacctaatttgaagctttgaatattattttttgaacaatgaattgggtttatatattaaagtgttctaaccaaaggtttgtttaatttattagagttattaagcctacgctcagatcaaggtagcagctagactggtgtgacaacctgtttttaatcagtgactcaaagctgtgatcaccctgatgtcaccgaatggccacagcttgtaaaaggtaattttgaattattttacagcctttaaaaggctgtcattgtaaagtgaaatacatactgtaaaaatgaagacaatgtatagttggcaggaatactgctaagaatagtgggcctgagagttgacctacttcatttaatctccttaaaatattttagtgtctttttttctcattaaaaatatcagtagccactatcaaagacctatctgtatgtataaacaggaaagtatttctcaaaaaaacttcaaggttttaaacattttactataaacattatagaaaacattaaaaatttcttaatatgcattttaaagtatgccttttatgtggtgaacgttttaactaaacatttctctagaagtttttataacattaataaaactagtatacttttctctcctagagagttacagtggaggtaaaaggagtggcttgcaggatggagaagctgcaccagtgttattggaagtgagccaccat

SEQ ID NO: 9445 - DNA, 1211 bp, Homo sapiens
ctgatgccgtggaccccacacttccctgcagattcatgaggtctgggaggtcgttttgagtagacaggagactgcaaagctgacctcagtgtgatgagaaggacaatgacacattcccgagccctgtggtgtggggagccgctgcagcctgatgctcgcacttccccggccatgctcatctccctcccgcctctttcccgcttccaccaccacattctctcctttccctcctgtcttgccctctcgcccctgactccatctcacctcatgtgcatctcccagggcggtccatgggttctggaggcctcattgagccccaccggttacccgcgtcatagaccgcagtgtgtctgaaggcctcagaacctcacacctgctcattgatgactggcacgtttttgttattgtcattgttgtcacttttaggtggaaataaaagccctttctttctcattccccctcagacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccaggtgggtgtcggagcgggatagtgcctctgagccccgagtgagcccagacgacattggcattgcttctgctctatgtgggtctctggaagctcaaagacaccaccgacaggaatatctaactttttgttttaatgtactttttctagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgt

SEQ ID NO: 9446 - DNA, 1215 bp, Homo sapiens
tatgttttctgctgttttgttcttagcaaaaaatatggttttgtgagcacgaagagtctaatgagcacagtaaagtaaactgcagccgtactcaatttctaatcacttcatgtttctgctcaacaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcgctcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgattttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccccctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaagtgtaggctgagctttcttaaccagtacaaccaaaaaatcaattagttcttgatatagcagtagtaaagatttcagccaagttgagattattt

SEQ ID NO: 9447 - DNA, 1136 bp, Homo sapiens
gtgtctgtgaatgttgcaggtggccggcacgcgacggctttaactgtcgatggaaaagtgttttcgtggggcgaaggtgacgatggaaaacttggacacttcagcagaatgtaagggtactttttttagtctcatttgctaataagaaactgtttctgactgatactcttgagaattattttgcagaaaattagaatagaatagattatagaaatggttcttaaacaaaatttttttaacacggttgtttgtgttttggtctcaccggttctgctttaagttttgatagttgatctgtggatcctgtgttgactacatgtggatcagtatagatgtcttttttccttcatctctaagaagggacagattgactgtagagagctgatttcatcttgttgtaggaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgattatacgcatttttgttgcttgcagaaagcttaccatctgaagatgtcaagagaaaataagcttcaagtctaggaaagttcataaagatgtgtgcatggttggctttatctgtgggaaaatccattgctttctccgtgcctgtgcgtgattctgtttttaaatttgtaattgagtaggtgaaagtccttctcggtcacagagtaatccaggttgcatgtgggagtagagacgcgcagaccctggctctgaccgatgaaggtgagtggctggcaggattctgtgcttctgggtgggtaggaatgatatgaaacgctggcctgaagtatatgtgtttcttaaacctaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggtacgtaaacgtcctccctgtcacactgtgtgtgc

SEQ ID NO: 9448 - DNA, 1165 bp, Homo sapiens
ttgtaattctttattttctcctgaattctgatagttcgaagagaatttatttatttttgagtgttttgtctggctttactagttgtctttgatggggaatgccagttgaattccagatttgccattaatggaagtggaagcactttacaatttactttttgccttgtatttataaaagcatttttaataagaatggtttttgtgagtgctgttattgaacttttcccacagcttattttgttttctttggaaatatattaatctgctgttgttccctgggaggttttagtagaataaatcatagcattatgtggacttcatctcataaattggtgtaactatatcttgactagggaaaccatttgtggcatttattaactcctttcagtttgaaactttctatttttctttaagaagctccttactatgtaatattcttgatcatgatgtttctccccagttcagcaagggttaattctctttttgactatcacgaaataggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaaggtagcatctaatagggcacagcagcgggcactttcacaccgatggttttgccttgtacattttcaaaatgaactttgagcagcctgcaaagttttgctgatagcacctgtcagtactcacgttatgttttaatttataagttatttcaaagttagagttatataccatccaattttattgtcagagattttaaacaatacgagtaatagattttatctaactgaccacttgatagaggatgtggtcaggctttttttcctcctctcctgcatagaatgtatgaattcagatttgcttctggttagaagtttttctagtatagtctagcaaatttgtgttgcacattggagtgctgttgtgattacaccaacgcgtggaggcacctcgtgggcacacaggtcagactttaggacagggcctttctccatctcgactgtagtgttttctgtcactcacttggtgggtaaaaggac

SEQ ID NO: 9449 - DNA, 1163 bp, Homo sapiens
gacttgcaaggcagatgtggcaatgcaggcgagtcttgtcttgaagagtagtatcacattgctgtttgaaatgcagctttggacaaaaaataatgacactgtgtttgttctttctagagggtcagatatttctatattagcctcatcagtattttaaatttcgttgtcttaatgtttacattccttaaacattgggaatgtggaagtattcctttggaagcaagatcttctgcagtttggaccactgcgcgcagctccataggcgcacattagtgaagcacgagggcatcattatctcttttgagccttccgtgcccttctgctccgttttggctgaggttgcgcttgttgcagatacattggacacacttggggagggaagccagctgcaggtcatcatgtatgatctgtgtttgtgatattaatttgtcatgatttaccccatcccattttctttttagtagaaatatcttgtttaattttgtaatcctcttctttcctgtatagaaacattgcttctcagactgtagccagattgaaagatgttgcccgtcggatttcatcatgtctggactttgagcaacacagtcgtgaaagatctgcttcattggatttgttactgcgttttcaacgtttgcttattagtaaactttatccaggagaaagtattggtcagacctcagatatttctagtaagttgcttaaaatgtgaaagtgtcttgtatgtgatcggggctcgttactttaggcttttcgacgtgtccatcctatatgcccagatgtgtagttgttatactactaaatgcaccaattttggggcttcattttgcatccacttttttgagttggacctttctataatagcctcgttaatatttttaattttgttgccttaatatttaaattctttagacatcagtaatagcatcctgtatgttcagtttagtcttacagaagatttatcagatttgttccatgtgctatggaatgctggagactggcatgatgtaggaagtaaacagtgacagcctattcatatgtcacatgggggagccagctgggtggaatgggaagaactgttggagaaagcctgggtttcagttacagctcggcttaatagtttagacattagaccaagtctaatggggccaaagacttctcac

SEQ ID NO: 9450 - DNA, 1099 bp, Homo sapiens
ctgaagagtgtgctatgcattgttaaatctcggatgggagaatatgatctaatagttaattaaaagcaccttgtttctttctgactgaaaatctgaatgaggaggagaaaaaaaaacagatcctttttgtatcctagtattatgatctttgtagactgtgggtcctaacgaattgtagctgacaaaatacagcagttttaataacacacccaaagcaaatgaattgtgcttaatattaaagcaaagcagattatcctcaagaagttaatgttaaaagctgtctgacctgaatggcctaggaaatatctttcttgcagcggaagtcataggcttgaagctgcatctgcatccctcttcccttgtagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccaggtactgaatatagagcttgatttggtattttggaggattttggtttccagttgttcattaccagtatgtagaaaataccactgagttttgtttgttgttcttgtgtcctgcagttgtgctaaactcatttattatgagcttcactgtagtttccttgggttttcttcatggacaattaaatgctatctgtatagaggggcagtttcatttcttcctttccagtctgctcgccttttatgtcttttcccggcctgattgccctggccaggacttgcagtgtgaagctgaataggagaggtgacagtgggcaccctgccttgatcctgactgtaggggaaggcagttcagtctttcaccatcaactgtgatgttagctgtgggtatttatgtagatgccttattatcagattaagggagtgtctttaattccccgttttagaagcttctaaaaaatcctgactggatgttaaaatttgttaaatgcttttaatcttctcaaatgaaatggtcatgcagttttccttctttagtgtgttagta

SEQ ID NO: 9451 - DNA, 1282 bp, Homo sapiens
tttatgaagggcaacaccatcaaggaaactgaagcctgggactttctgcggcgcttaggggtctaccccaccaagaagcatttaattttcggagatccaaagaaactcattactgaggactttgtgcgacagcgttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaataattgcctatatccttattatgttaacctattttatttttctatatttcgtacatatataagtattattcatggttccaagcaatgagtgtaatgtattttctcccaatagtaattgtttatattcataattattcagctctgctgctaaacacgtagttccacttcgtttttttcttcttgctactgtagttattacaataaatactgtatttttgaagcacttaagcattgtgtgttttttaaatcgtgggtcatgagagaatttcatgactggaaatcaacatcttaaagtttttgctacatattaaggtcaatgctgttttgtagaagttgtttcacttttgtgtgaaacaaaatcaggatcatgaggtgaaatatatttctcactgtggatctcaaaaaggcttataaaacaatagcgtaaccattaaccatgcctgtttgggaatcggactgtctgggttgagatcctggccccaccataactagtatatgaatttacataggt

SEQ ID NO: 9452 - DNA, 1399 bp, Homo sapiens
cactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctg

SEQ ID NO: 9453 - DNA, 1173 bp, Homo sapiens
taaacatatttatgttaatacaaattatgatgcccataaatcttctttaggatttttcagtgtcaaaatgaagtgtaatcaatagtgcattaattttctactaaatttaatatttatctttaactcactgtttatttagtacatgctgaaacataaaagcccctacctgcattataaattttgagctttcacttaaaccagctttttccactaatcttgtctatcctgataataaatggtaaaacataccattttcacatattaaatcgtagtttaatatttaatcacagtctaataaaatagactagaattagaaacaagactttgtccttaaatgtgaattttttatacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaa

SEQ ID NO: 9454 - DNA, 1196 bp, Homo sapiens
gttttaggggctgtcctgtgtattgtggatgtttaggggcattcctagcctctgctcactagatgagatgccactagcacacaccccttaccctttcagtacacagatggggcagtcaaaactgcatattggcaaatgtccaatgttggatggcgagggataaaattacctttatttgagaactgctgatttagatatggaaatgtctataatgtttgcagataagttagatgatataatagaaaacaagcatgtggcttttgacaagttacttgatgtattttctgcatcagtttcctcatctgcaaaatggaagtactaagagtttcaattcttacagtgatgaatacatgaaataatacagtacctggcacatagtaagaatttgttggatattattattgatattatcatagcatctttacataatgtactgtctttcagattgttatcccactaaatattgataatgtgtttgtttttattccttttagtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacaggtatgaatgcttggatacttctcatagagtgaatcaagtaaatgatgatagatcatttcaatcccactgggaaattttggtaatgtaaagaattctttttcattgtattcaacgtatctataactgacttaggtttacaaactcctctttattataaccattaagatttaaactgtatgtgaacttccatccagtattgtatatttcatttcattgtgggtctttttccattttgcattttaaatgcccttattttaattttctcctttcttgtgtagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaaggtagtttattttctacaga

SEQ ID NO: 9455 - DNA, 1661 bp, Homo sapiens
tagtctgtgctcttgtttgaagcagttttgccaaagagaattaaaaatcagtgtttgggggagagggatataaattccctttatgcattattacatgtcgacaccaatgctttaggtatcacagggtcatcctgagataattattcacaggccggtactactttgtagatagatatgtctgttcttacacattaaaaagttctgataattgcttccagatactattgaaatgcttatttattcgtttgtttataagtaatagaaagtgacagcctcaaagaaggagttaggggatgctactatgggtttttctgacagcaacagtacagtaaagattttatcatctcaagaaggtggaatactttgacagtttggaaaagtgtagagagaatattttggttttcatagcaaggagtggtttggatatttctgtttataacaaactaagttaacatttgtattttattatttactttcaagctgtaatttattttctgttgcagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacggtgagtgtgattctgtttgaacgttccctctaagtgacctattttcttaaaatactagggagattgaacatctttgaatgaaatgataattttctaccagccaaacaccttcaaaatctataagttttatatacattttttcctgtagacaactcaccactattgatatgattgctggcaggtgaaattaatgcataaatcttccattttatatataattttacttactagcttatcttcattattactggagtaccttatacttgactgtaattatttttgtgggaaaataagtagcacccttttattaacagacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcaggtaagacaccctatttttttaaaaaatacaggggttttgtttgcttgataccagtatctgaaattgcttacaaataaaattaaaagatgtatttcttttgattattcaagattagatctgtttttctcaacttagacattttttaaatctaaaataaccgcaaactttcccttaaagggccagatagtaaacatatttcaatcatgcaggccatatagttcttttcactgctcaactgcaaaagcaaccatagacaatgtgtaaatgaatgggcatgactatgttcccataaaactttatttacaaaagcggttgatccgcagctgcagtttgtcatactattgcattagaagatgctagcaagcttcagaaatctactgcttgggaaagttaactacagaagtcctttaataaacacattaacctggactttgttttctcttttaaaaatacactagtgttggccgggcgcggtggctcacacctgtaatcccagcactttgggaggccgaggcaggcggatcact

SEQ ID NO: 9456 - DNA, 1176 bp, Homo sapiens
gagtgttcagtgccgtctttagaggagtatctttcctttcctttgtccagtgagaacacagcggagtattcagagcttgcctctgggaaatgcctcctccctgctctccagctagcgttgaggaggtggctggaggagggaagccctctgtgtcctggggctggccgccagttccctcgtgaccttgggccagtgatcacacatgctcggcctcggtttcctctctttgaatatatcaatcaacttgttagctttattaatgtcctttatcttctcttctctttgcattggccctctgtttaaaattggtctttctagtccataagcaggtgtaagagataagctgctgtttcgcagcaggctcctgggagcacaggttgtgttactgaggcagaatcgttagtcttcctaacatccctgcagggacagttctcctgacaggaattgataagggcacattatgtaaaatctggagggcaagcctttcccttttaggtcaacactcacccgcaagctaaaaaggctaatcaacagaagcattttctgtgttcattccagagaatttcccaggggcacaataaatctagcctgcctgtttacaggaacattgttatttaacaagctagtttccaagcttaagagttttcggtttcatcaaatctaacccagcttgctaaatgcctgacattcattattgtctgctccggttcctctgtgtattataagataattttgcatacttaatataaagatagtttttacacacaggactaaccttaaatttattagaaaactattctaaactcttggatccctttctcttttttttcttaaccatttacctatgattccatcctgtctttaacctgcccactagtacttctagctagctagtttatctgatttacacattcagtaatttatttgttcatccatctaatgttattttgagcctctgctctgggctatataaatgtgatattagaaagaggaaagggacaggcacagtggctcacgcctgtaatcccagcactttgggaggctgggcggtggggggcggggtggtggattgcctgaggtcaggagttcgagaccagtctggccaacatggtgagtctggccaacatggtgaaaccccatctgtactaaaaatacaaaaaaattagccagacgtgg

SEQ ID NO: 9457 - DNA, 2670 bp, Homo sapiens
ccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcacgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatgga

SEQ ID NO: 9458 - DNA, 1058 bp, Homo sapiens
catacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtg

SEQ ID NO: 9459 - DNA, 1150 bp, Homo sapiens
gagaccaagtgtgtttgctgtgcggctgacagcctgactcccgggtcctgttgctctctgtcctgtaaattaagagcagatggagtggataaactgagagcgcaggagaaggtaacacaagtcagaacttccaccaagggcattactgagacatggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaagcattccatagtttagacgtgaatcccacatctcagcaggatgattccagcaatggcttggatccacaggaagcagggtctcgggtttcacctgacctcggaaatgatgagaaaattgcaagcgtggagacagaatcagagggaagtcagagaaaagaagcagggacatctctccttgctcaagagctgcttccactgtctactttgaaagggacaaaagacgatgtcatttgtgttcgtgggaccctggtgcacaccaccagtgattctgactctgatgatggtggccaggagccagaggagggaagcagcaccaatggcccaaagtcccctagtggtgttttatctgagccatctcaggagtccaaagaaaacccaggaggtttcagggaaaatactgtcactggggaaatgaatggtgcagagctctgtgcagaagatcctcaaaggattccacctgagatgagcagcaaactggaagctggcaacggtggtcttcagacagagcgtcgccccagccaggaccaggtgggagaagaagggtcccaagacctacctgcagtaacaaaccagaattcgagtgttggtatcactgagagtgcctcttctaaaaaagaagtctctggagagaagtcattccaacttccagcttttttcagtgggcttcgtgtgctgaagaagggggctaccgctgagggaggagagaccatcacggaaattaaaccaaaggatggggacttagctttgctcaaattgacgcagcctgtgcagaagtccttagtgcaggcagggctgcagacagtgaagagtgagaagaaagcaac

SEQ ID NO: 9460 - DNA, 1302 bp, Homo sapiens
atgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttattcctgtagttatcactgtcttatgtagcagtttgaaccagttaacttggttggagtatggtgctaaagaggccgtggacaggagtttgatgcttttgtaggttcattaactttacatacacacaaaatgtttttatagctgtcgattgcaccttccgtcaggtatccatctcagaaattcaggaagatggtatgtatagcttagcataaacctttcgcctcaaatggaaagattactcaatgggtatatgtgatactgtagacttttaatctaacatttaaaataatagattcaaaataagatatctaaaatactgtgtaatgtttagtttcaaagtattaagtaatattacatcagatatttttcacatttttctctgggtcagatcattgactaaacagtatcttcaaaaatcaaacttcaataaatcagacttcagaaaaattaagtacaaatgacatatagtaagaacaggtattatcttggtaacatttatacctaaatttaggttttttgaaggcatgtagataatactttatcttacatactcagagctatataagtcagcagagtttttagctgacaaagattattgagtagcatatactcctaatttctgttcttggcctttgcagtttccttagtacctacccctctcagttattgaattgattagtat

SEQ ID NO: 9461 - DNA, 4066 bp, Homo sapiens
atgatgatgccaggttttaagtttgtgctcttcttttgcctgtctccttgacaagttttgaagacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctccccccgcccccacccccgcgcctttttttatgccctcttattaagcacaggtcaaaaaatcttaaggaacaaatactaggaaaactggctaaacatccttccctgaaagcactggaccatcttttaaagggcacatctagcaatggaattggaagttctagagccacactctttctttagtgccaacgttactgagcggctactctccttacctactttactaaaatggcatacagattggcattgacctgttgaagaaattttaccactaagaaatcttttgcctcatctacaaagccatagttaagacttgaggcattcaacttaatgccaagtataagcatttccccctttttctttcaattttattcttcattctgactacagaaacttggccctgaactacgagattagccaagccaacagtcttctaatttgttttcagaaacttcaggccgggtgccgtggctcacacctgtaatcccagcactttgggaggccaaggcaggtgaatcacttgaggtcaggagttcgagaccatcctggccaacatggtgaaaacctgtctatactaaaaatacaaaaattagctgggcatggtggtgcatgcctgtgatcccagcaacacggaaggctaaggcaggaggatcatttgaacccaggaggcggaggttgcagtgagccaggattgcacctctgcactccagcctgggtaacagagtgatatgtttcaaaaagaaagttcagtgtgccaaggaaatacttgtgtaagctcagctttttatttactaatatactgatcaaacatctggcttacaagcatagggaaactacttatgtggctggctgagcagtaatttcaagtatgtgaaatcttcatttcttttacagaatagttatttagagaaacttttcttgcctgtattcatggctgtttttgaatttcaatttattagtcataaatagtgccactcttctttgattactaaataggacatggagcaagctgacctaggtgtcacaaattattcatttgacctgtaaggacagagaaaacccttcaatatagcttaagaaattgagtaattttgggccgggtgcagtgactcacgcctgtaatcccagcactttgggaggccgaggcaggcggatcacgaggtcaggagatttgagaccatcctggctaacacggtgaaaccctgtctctacaaaaatacaaaaaaattagtcgggcatggtggcgggcgcctgtagtcccagctacttgggaggctgaggcgggagaatggcgtgaacccgggaggtggaacttgcagtgaaccgagattgcaccactgcactccagcctgggcgacagagggagactccatctcaaaaaaaaaaaaaaagaaagaaagaaagaaattgagtaattttgatttgttccctttgcttgcttcaacctccaggcccactgaggatggcaaagcggataggatcttaagtctttttttctgttacttcctacagatggtagaagcattatttacaactcccactgcaacactccattgcttagttgagtttaacagtagtgagtcatgtcctgcaggatccagtatcttttttttttttttccgagacgtagtttcgctcttgttgcccaggctggagtgaaatggcacaatcttggctcaccgcaacctctgcctcctgggttcaagcgattctcctgcctcagcctcccgagtagctggaattacaagcatgtgccaccacacccagctaattttgtattttcagtagagacggggtttctctactgaaactgatgttggtcaggctggtctcgaactcccaacctcaggtgatccgcccgccttggcctcccaaagtgctgggattacaggcgtgagccactgtgcccaaccaggatccagtatcttaaaggcccatactgtaaaggtcagcctgcctaggaattctgccacatttacacacacccctggccaaagtaatattttttttttccatgtagaacaaattatgggcagaaagtaaagttagttttagaagtgctgtttgtggttggagaattgtaaaaatcttttaaagggataagggaattagtggcttttaatataaccactgcttcagcccgaaacacaaaatcactgttacatggaaaactggttattaggccagatttatattcatgtctgtctagagtatttcatgtgtgtatgtgttgcttacgttgtctgtctccaaagtctctcatctcttttaatcactgcaaataaagcaatactgaaaacttgagagaatgcaccttaggggaaggggctatttcaagacagaaaacaaaggaaatacctgccttttgaataagatcccgcttttgagtcttacctatgactttaccagggtagattagaaatacacatcctcctgctgaccctctgccttcaatagctatctatcttaaaagctgaagtttgaactgcagcatctgcttgacaggtgccaggttccttcggcagggggacgatcactctatatatcttccgttgcctcagattcctgtggcccaaggatcccaccaatcctcgttccccctaaacatgctaacaaaaatcccttatcgtgggtattaaaataataacagttacactgtatgcatatttatgtgctccttttgtctggtttttcttttcatcatgtataagctgaattcagcattagtttctcacatcttcccccaggtatccccaacagaatttttatgtcccagcttgtattaaatagaagtgaaatattaaggaaaataaggaacttgtgcaactttttttatgcattgttctcaaccatttaatttattgaaaggagatgctgcaacagttcttgatttagcagcagttattctcttgtttacatagttatgtttttttgttgttgttttgctctgtactggaaacaaaaataaagttttctacattattttcagccttgggttatggtatagtttcttt

SEQ ID NO: 9462 - DNA, 1111 bp, Homo sapiens
gaaatcatcagagaaatgcaaatcaaaacttcatataatttataaaaggtcagacagctgtggaggcagagagcttttactgtcattatcagcagcaatagtgtgtaaaggagactacatctaacacagtattataccctgagtatatactcaatatctttttttcctcctaaacttaggtgactttaagagtagagtctcggctgggtgcaagtggctcacgcctgtaatcccagcactttgggaggctgaggtgggcggataacttgaggccaggagtttgagaccagcctggccaacgtggtgaacccctatctctattaaaaatacaaacaaattagctgggcatggtggtgcgtgcctgtactcccagctacttcaaggctgagacaggagaatcgcttgaaccagggaggcggaggttgcagtgagctgagattgcgccactgcactccagcctgggcggcatagcagctccatctcaaaaaaaaaagagtcttcatgggctggaattccaaaagaatagcgtctctaggggtcttgattattgttaaggaaaggaatgacccatgtttacttctcagagttttctttttgttcctgctggagagttttattttgttccatattctccaagcagtgctgattgagttctaagattaaatttgaatatgaaaatgggttatattaataccgaagcaacctgcacttatctggtgctgatgtttcttcgtcagaaaccagtgagaaactaacttggtctacttttttttttccagacgacggacataagaaagctcgaaatgcttatctcaataattccaattatgaagaaggagatgaatattttgataaaaatttggcactctttgaggtaatattttggagaaaactatggactgagactttaggaacagagatctcatgatagccatattttaccccatttggtttaaaaattttacaagctggataatttaatgttaaaagaaaatattgtaacttgttattatagtaaattttgtctgtgtaatctaattatagtgagtaactattaaatcaaattgttatgtagtaaggaagaggagtttgacttcttggacatatagat

SEQ ID NO: 9463 - DNA, 1224 bp, Homo sapiens
gggactacaggcgtgcgccaccatacccggctaatttttggttttggggttttttgtttggttggttggttttgtttgtttgtttgttgtagagacgaggtttcgccatattgcccaggctggtctcaaaccatcctcccgcctcgacctcccaaagtgccaggattacaggcgtgagccaccgcgctcggcctttttaaattttatatttctctatttatttgtacaactttttgagttgaccattgcatcttctattttcatgtttgccctttttcgcgctggccccaccccatttcatcactcctgtactgacatacattctgtgttcctggagcagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactcttattttgtgagttgttggaggaaaggattggcagtatttttttaaagggagggagatgataaaggagagtaccccagagagttgcaacaataccacttggaagaaaaacttcagtcctgctgttgcaagagtggtcatgtgctgttcatgataggagggtattggggaagaaagattaagactttcacagctgtcagcattcactgaaaaatacctctgttgtcacttaacgtaatttcttgtcccttgaaataagattttgattaaaaatggaagagtacttgtaaaagtaataggcatattacagacagaggtcagtgaattgaaagtcagaagaccagtatttgctttttgtataactttgagaaagttacttaacctgtttagtctgatttttctcctgattaacttatctttgaactcaaattgatttagtggtgggcctttctttttttttcttttgagacagagtctagatctgttgtccagg

SEQ ID NO: 9464 - DNA, 1213 bp, Homo sapiens
aaaccctgtgtctactaaaaatacaaaaattagctgtgcatggtggcgcatgcctgtaatcccaacaacacgggaggctgaggcaggagaatcgcttgaacccgggaggcagaggttgctgtgagccgagattgcaccattgcattgcagcctgggcaacaagagcgaaactccgtctcaaaaaaaacaaaactaaactaaaacactgttaagggcagttaaaacccagcccatattcccaggctgttttttttgttttgttttgttttttctttagggttgaaaaaaaactaaatccccattcaccgcacacggcactcttcactaaccacgagaaaccccacccaacaccatccaccgggtccctcccttgccctcctaatcccgccagcgaggtgtcttctctctgccgcccgctagagggcgtgtacagaggaggtcaaagctcttggctcgctagctcagccccaacgcctgcatgaacttccggctacacgccattccgcttcccgaggaacgcttgggctgttgtacgggttccctacgggactctgaaggctgaggatatccggcccggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccaggtgagctcgggcgagtctggtgtgtgtgagtgggtatggacgtcgtggccccgaggcctggtggtggggttttttttcaggatttaggagtccggaggaggcattcgtttgttaattgattcacacacgtctttttactgagtatcagctccgtgccggccactatgctaggtgctgggcataccgtggtgaaagaagctgccctgccctggggagttcatggcccaaggaagacagacgcatgaaaataaaactactgtatgagttttgctgtgttggagtttgtctcaggagcaatggattcagagaggagggaacaccccagtctatctgagactggcaagtaggcttcgcagcagagtgatgctggactgcctcttcaagtaggagtaggctttttcctggtccttagagtgtcctgagtttttgagcagcgatgagaa

SEQ ID NO: 9465 - DNA, 1146 bp, Homo sapiens
gcgtcagcaggggcggcggcgggtgggaaatggcggagtgtccagcctccatctttggcaccgagaaagtcaactgttcatttgatttcaaaattggagcatgtcttcatggagacaggtgctcttggttgcaccataaaccgacgtttagccagaccattgccctcttgaacatttactgtaaccctcaaaacgcttcccagtcggccgacggtttgcgctgtgccctgagcgatgttgaggtgcaggaacactctgatgaattttttgaggaggtttttatagaactgggggagaagtatggggaagttgaggagatgaatgtctgtgacaacctgggagaccacctggtggggaacgtgtacttcaagcttccccgtgaggaagatgcggaaaaggctgtgattgacttgaacaaccgttggtttaacggacagccgatccacgccgagctgtcacctgtgacggacttcaggggagcctgctgccgtcagtatgagatgggagaatgcacacgaggcggcttctgcaacttcatgcatttgaagcccatttccagagagctgcggcgggagctgtgtgggcagcgtcgcaagaagcatagatcaagatcccgatcccgggagcgtcattctcggtctggagaccgtggtcatggcgatggcggtggcggtggcggtggcggtggcccaggcggcggcggcggacgggagcgtgacaggaggcggttgagagatcgtgaaagatctgggcgattctgagccatgccatttttaccttacgtctgctagaaagtgttgtagttgattgaccaaaccagttcataaggggatttttttaaacaacaacaacaacaacaacaacaacaaaaacacaaagatcggtttctgaacaaaatttgtagtgataacagttaaaaaaaaaaagattctccataaataggtcgggcgcggtgcctcacgcctgtaatcccagcactttgggaggccgaggcgggcggatcacaaggtcaggagatggagactattctggctaacacggtgaaaccccgtctctactaaaaatacaaaaaattagctgggcgtggtggcacacgcctgtagtcccagctactcaagaggctgaggcaggagaatcgcttgaacc

SEQ ID NO: 9466 - DNA, 1294 bp, Homo sapiens
aagcgatttatcatttttattttaaatatattcatggttgaagtgtttcaacgttattggacaattaggaagaatgtccttaactcttacaagttattttataactgatttttaaaatgctgtttttcagtattaactatgttgaccttagaaaacttttacaaaaaatagactttatgttttagaacagttttaggttcacagcaaaaatggagcagaaaatgcagagatttcccatataccctctacctccacacattcacagcctcccctaccgtcaatgtcttataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtatatagcttttcatgcagtatatagcttttcagattggcttctttcatgtattaatatgcatttaggtttctctgtatcttgtcatgtatatgtagctcattttttttttagtgtagaataaaattttattgtctggttctaccacatttcatttgtccatgcacctattgaagaacatctcagttgcttccatgttttggcgattatgaataaagcgactataaacatccatgaacaggtttttgtgtgaagataagtttttttcaggtgtataaataccaaggagcacaattactggatcatatggtaagattatgtttagctttgtaaaaaaaactgccacactgttttccaaagtagttgtactattttgtattcccaccaacaatgaatgagagtttctgttgttccacctcctgaccagcattgagcattgtaggaattttggacttttgccattctggtaggtctgaagtgttctctcattgttgttttagtttgcaactacctaaagatatgtgatgttgaacatcttttcatgtttgtttgccatctgtgtatctcctttggtgagatgtctcttcagatcttttgactatttttaattggggtttttgtcttattattgagttttaagagttctttgcatattttggataacagttctttatcaaatatgtatttgcaaatatgttctaccattcta

SEQ ID NO: 9467 - DNA, 1134 bp, Homo sapiens
agtatttcacagtgatatataatggcatttaaaaaaaccttttaaacctaaattcactgatttttaagaattgagggagcattgcaatgcataattaataccgtagggcttggtatacttaattgaaatactattcctattggccttgtttttctcaattgaaatgaaagttgattctcagtttgtggtcaattttctacacttctgataattttgtggtggacctgagttccagaataataagtgagaatagcttagaaagagagagaaaggcttttattgaactggaaattctactgatggttttgccatagaaatagaattaatttacatgatctttaaaattaatattcatacacccaggaaggatatctagggttatttctgtattaatcattggactaggtaggaatgtctaagaaaagagtatgattatttcatgtgttttctttagtgatcttttacatttttttctgtattattattattatttttttactttgttgctacattgtagcttagctttaaagactcttctgaaaggttattatgttagtgtatggccccttcactttctaaaagaagtgtttagcttttattagatatttgtgcatctttgcattgtgtagctgcgaaagggatatgagcttgaattcttcgcagaggagtatttgaagaaagcctcagataatgttattctaagaagaatccacatgctataattatatttcttattaatttggggggaattttcatgtaattagaatattggctttatttaaaaaatctatattcaggcatcaaactttagtttactaagtaataacccttaccagaatgattgcttgtgcaataaggagaaattatatatttctctaggggaaaaaaaggttcaatagaagtatagtttaataatattttattatttaacttttgacaaagtcgactgaatttgccattgtttttattacacattttgtacagttttgccgtattggttgaattttccttagaaacaaaacaatcaatatatgctttactagattaaatctgaaaagtgaccttaatatatgaagtcatgctctggtataaagatcatatagaagataggtaaagagtaaatgcttctttatt

SEQ ID NO: 9468 - DNA, 1269 bp, Homo sapiens
acacagatacacaaaaggcttttaaatccttaagagaagaagttaaaacatttcagggcaagccaattatggcaaggataaaagccatcaatacattttttgctaagaattgttactaattaatggattctagtatctatagtcagcccattcagactcaagcacagtatgcctccccagtctttatgcagcctgtatataatcttcaccagcagttctcggtctatagtattattcctcagtcttggtctccaaatcctacaccttactttgaaacaccactggcccgctttcccaatggtagttttgtgaatggcattaattcaccaggatcttataaaagacatgctactgctatgaatatgggtcgaccattccaaaaaaaaacctgaagcctcattttaggtcatccagtggttcagaacactcaacagaggactctgtatcattgggggatggacaattgaacagatctagttcaaaaaatttttcaactgaaagcataatcctacagtaactggggattaggagcaaacttaacttcaaaaggagacttccactttgcagatggaacaaaatggggactatggtaggggcaggagaactcttttcagaggtcgaagatgacgacaagatgtcaatctcaagacctcatccttcaacagctgaatcaaagcctccaacaccaaagtttgacttactagcctcaaattttccacctttacctggaagttcatcaagaatcccagataaactcattttggagaataggatgtctgatgttgttaaaggtgtctacaaagaaaaggataatgaagtgttgagagttagttgcccagtgcctgcagatgagcagacagaatgcacttctgcccagcaactcagtatgagtaccagttctccatgtgcagctgagcctactgcattaagcacaactcagccaaaaaaaaaaaaaaaaaaaggatctaatagaggattcctctgttcagaaggatggtctcaaccagacaactataccagtttctcctccaagtactacaaagccatggagggcaagtactgcctcaccatgtaatcgtaacataaatgtagctacaccgtgactctacaggaaccctgaaagttaagttatgctgaagtgtgccagaagccccctaaagagccatcttcagttcttgtgtagccactatgggaacttcgctccaatgtagtgtctcccacgacaaacaaagacaatgaagctccttagaagtcccttgagaaaccaaa

SEQ ID NO: 9469 - DNA, 1134 bp, Homo sapiens
tgacgtaatggcaaagagcaatatgtgccacccagatcaccaaagtaaaaaacaacaaaactattcaaaaacttctctctcttcccgttaaacttgagctgtagctatattgaactgttttggaggggagagggtaaccaggaaggaaacaggagaaagtacatccttaaatcattatggattttggagttgtgagtgataggatcccaaaattcatctctgatgtgatttataaatgctggaggatttctatctatctatctatctatctatctatctatctatctatctatctatccatccatccacacacacatataaagtgtattttttctatttttgtttttggttttaatttgcagagatttgctgccaggaatcaattttgagggttcagtttcagcttggaggaaaaaaaaaaacaacattatacatccttcagtataggagatgagggagtgagaggaaatattttttgaagaagcatttctgtaaaattagaaattactttttaaaatctatttaaagtttggcgtggagaatgccatctctgattatatggccttgtattgcaaagcggattagtggctggggtgcctgttgtgggtgtgagtgtgtacaagagcgattgaagcaaaatctgttgtcatgttagtaaatgatttgaaaactgaatgtaaaacttgagtagattttttttttttagtttgaaattgagtctgtctttttgaccttactaatatttccttcaacaagttgtaaaactgtgattgtacttggacatgtgactactaatcagtttgatactcaaggaaagaatggggtttcttaaaaacattgaaaatttcggccgggtgcggtggctctcgcctgtaatcccagcactttgggaggccgaggtgggcggatcacgaggtcaggagatcgagaccatcctggctaacacgatgaaaccccgtctctactaaaaatacaaaaaattagctgggagtggtggcgggcgcctgtaggcccagctacccgggaggctgaggcaggagaatggcgtgacaccggggggcggagcttgcagtgagccgagatggcgccaccgcactccagcctgggcgacaaagcgaaactctgtctcaaaaa

SEQ ID NO: 9470 - DNA, 1243 bp, Homo sapiens
atctgtcctccatcagctaggtagtcacatcagcccaagctcataacaccttactgaaaggtaagattcagagtttccatatctgaaatacttcaggtttctggaaagaaagggaacacatccatccgagaaggtagtatgtgtgttatgtgaactctttggtataagtttggctattttcagtcacaatggtagcaaccaaaacaaaaattttgtgcagtcctgtcatttaatcatcttatcagtgccccaaggtgacttttttcaagagctctgttgataccatgtgtgtgtgttattttctggtgtttttacagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgagga

SEQ ID NO: 9471 - DNA, 1219 bp, Homo sapiens
aaagtgtggattcacttactcattgaatcaatacatttaaactttaaatcaaactgttttctttggggagtgtgtacaaaaataactgcttccaggccgggcgcggtggctcatgcctgtaatcccagcactttgggaggccgaggtgggcgggtcacgaggtcaggagatcaagaccatcctggctaacatggtgaaaccctgtctctactaaaaatacaaaaaatttagctgggcgtggtggcgggcgcctgtagtcccagctacttgggaggctgaggcaggagaatggcatgaacccgggaggcggagcttgcagttagccgagattgtgccactgcactccagcctgggcgacagagtgagactctgtctcaaaaaacaaacaaacaaacaaacaaacaaaactgcttccaaatgaagatacaatgcccccacttcaagtgacctacagcctaatggggactaccaacaagtaagctggcatgttgctacactgtacttacactacagaaacaactgtcatgtaatggtcaacaaacatctggcaactgccaaataagtgctggtaaaccaacaattaagctattccattatgtgaaatgtggcacatagttctgtaaacatgagttagcccgtagtaatagaagtgcagtatcactgctagagttgtaatagtagctatatttatgtgattggaccaatgttaacattcattttcaaagagaagatctcagggaagagttttgatggcttgggagaagtaaaggaaccttgggcagagaccatatctgggcctaaggcagttgtagtccgagctgaccctgtgtgactagaagtccacacgagtatgcaagggaattgaagctgaaagaagaagtcctgaaggcaaatattactaccctcccaagccgaacctacaccaaacctaaacctcttgtattttcaaacgcgaatactgtcatgagcatataaatgacagagttaggtcacttgcatgataaggtggcagctgggcagtggcagtgcaagcagaaatcccactgggctgaaaatttacaggaaaaccatgagctttagtttggttcttcctccaaattgtctaactggtcacttaacctctctagttctgtcctgacttgttaactctcaaagaacatgactctttgtgtttagcatgttttctgatggttaatgagtcagcaaatgaaggaaatgt

SEQ ID NO: 9472 - DNA, 1905 bp, Homo sapiens
agtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatataacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttgtactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaatagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggtgatgaaatggtttttattttaccttggatctttatagttaacatacccagtttcttaatcagtctacaagactaactgatgatataatgttctctgaatccctatatggaaattttcttttgagtaaatgagaattcctttgtgaaagcaaatgggtagtttaaatcactgattcttaaacatgtgtataggcaccttcaggaacattttctcattctctgtacagattcggcactgccaattggcttttcctctaaaacttttctttgtttttatctgatataagcagatggctcaagacaactgcttgagtaatagtattgaaaatggaatcatctagacggcatgacaagcaagactggtctgatgaacttgttcagaattgataattcttaaatatttctcttggcttcaaaagggacatcatttgatttctgaagaagtatgtcgtgtggagcttcagcaccacctactggatgatttccaggccagagacatgagatggcaatagggatctgacagggttcatcactactaccattaaagggctatttatgtggtgaccacctctaccagggaaaccaggaataagaactgtctcaaaggaattgtaaaatggttatttacctaatgtgtcttgttggcttgctgaaagattttaagcacttttttcttacatatcctgttttaaaatatttgttgatatttgggactggcaatcaaacttaatggatgtactgaggcatttatagaaccagttgctttaactctcaaaagccattaccaaaatggtatttttttcctccttccgccagtcagggagaatttttaaaaataataatcaaaacatgaaaaaacataatcacacctgtattttatcatgacagcttcagagagtgtgtgtgtacgtttttctctcttttatttgagacggagtttcactcttgttgcccaggctggagtgcaatggtgcgatctcagctcactgcaa

SEQ ID NO: 9473 - DNA, 1565 bp, Homo sapiens
ccctttcttttcccatcatttacccaacctattgtctttgcccctcatccaactctctacctctctctgcttcctaaaaatgtccactatctttcatctacaacacagtggatattttgctatactgtccatttcttctcagaaagattattcctctcttgttttcactctggattctccattttggacccaaactgagaagcccagagctgctgctaggagactggagccagggtacccaagggagcccatctccgggcgcccacccttggtacaggccacctcgcttcgcagcccagggaggaaaggagagggggtatgtaaacagctgtgggagtcgggagtctcaggagttgcagcaagcccaaacccaggccccccagcccagcccagaccatgggctcactggttcttccacccaaccagcccgcacctgtggaattagatggagcacagttccatcatcacccaggcacaggggaagatgccctggtgctcaccaagcaaggcctggtctccaagccctccttaagaagcctcgtggatataacatcttcaaggcccttgtctgctattttcgcatccagcatggccagtcaagctcttccactgagctcatccatataaggaggaagccaacaccactgctaagtcggatctgctccagtgtctccagtaccagttttatcggatcccagggacgtgtctgccccaaggtgacagaggaagatcaaaggaggatctgtgtggtcactgacctggatgaagcccttgtgcatctttaagcccagcaacaatgctagcttcacagtgcctacagagattgaggagaccactcaagcaggtttctgtcctcaaaagagctcacgtggaaagagacgaatgagagaactctttgaatgtgttcccttcactgccaacctggccaagtatgccaaccctgtgacggatctgctggccggtgtggggtgttccgggctcacctattccatgagtcctgtggttccaccagggctgctaagtcaggaacctcagccgcctggggaggaacctgaggaaaaccctcatcctggacaacttgtctgcttcttacatcttccacccagagaatgcagtgcctgtgcagtcctggtttgatgacatggcagatactgagttgctgaacctgttcccagtctttgagaagcagagcagaggacatctataccagccttgggtaggggcaggcctcttagccttccctgcttccaagcagtggtcatcccagtaagggtctttcctatgctgtgcctttaggatcacctgacggacagagtgaaagctggagggcctcaccacatgggcctggaaatagtgagaagtgattgtaaggagctttaggacagcttagatgccaagtaggcaaatgccagaccaacaatacccagaactacctgctcccgagttgttgggttcccgagatgtgtgtgtgagtgtgtgttctgccatgaactgtggccccagcatatagcgtttcagtgggggagaagctgaaagactcttggtctttcaagtcgtctcctctc

SEQ ID NO: 9474 - DNA, 1278 bp, Homo sapiens
ggaggaggaggttggggaggtggtgggggagggggaggagggtgggggggaggaggaggaggtggtagaggaggtttccaaggcaggggagattatggtggaagagggggttatggtggaagagggggctatggtggaagaggctatggagatccatatggaggaggtggtggtggtggtggtggtggtggtggaggaggtggatatagaagatactaaaaactataaaaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcaaatgaagtgatgactttttccatattctgtgtacccttgagcatgttgtgtctttttaaaaaacaaaaaaaagaacaaaaattattttttaaaatgtaaatatttattaccatcagacttggaaaatggaaagtattttattgtcatgattgaatttagattgttacctgtattttgttcaggtttgagacatataaaagaccccacctgtaatagaaaggaatatagacccttgcctcacctgtattgctgtggatgtgttttgtgggtttttcattcgattttacaaaatagggaaaggcacttccagttgtatttagtaggcagttgttgtgaatcatttttttctcttataggaggagattcctctctagccatgtttctgttaaagtttcattaattgaagcccaagtttactttttactgtacatacttattttctaattggatttgaaatcagcatgattttgtttgacaaagcaaagtttaagattgaggtcagaaatactttaatggagcaaagacacataccaactttacatgacggtgtgagaaatagtcctataaactggtctcttcatcatttatgctctcactttagatatccaaatattaaaaggcaggctgacctgtatcacacagaattaaggcagtaattttctgcttcagtagatcaagggtagggctaaggcatcctgtggtaattctgattcacagctagatttgggaaacacaaagttagggaatggctatatgtgatttgctagttggagcagtcaaagtcttagctatcaagagttgtgaatttgaatcatggcactaggtcaggggtgctatggattgaaatgaccttagttctcaaggagtgatttgtcctcat

SEQ ID NO: 9475 - DNA, 1572 bp, Homo sapiens
aataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaattt

SEQ ID NO: 9476 - DNA, 1244 bp, Homo sapiens
gcaattttcccttggaaaaaaacgtaaaaaatgtgtgcaactgtctgtgggtgttgcagaagctgctataatgtgaaagagtgttttatgcttataccattttccggtacaagtgtccaatggtgctatattctttcctgatttttggctaccctaaatccattatgcagatagggctggtgttctgccagtttgcacatcttcccactaaggtatgctctgttgtatctttcaggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaattatgatttttggtttctttatgccctttggtttggatattttcatgtgcttagtcattacagccaagggaagaaaaggctatttaccttatgttccagctccctaaaacctttagtgttaatagatttacaattaaaaagcagcaggtatatgaaagcatttattatatcccaaaagataaatttataatatattacacatgaaaaactaacaaagctcaactttgtaggacagcttcttagaaaaa

SEQ ID NO: 9477 - DNA, 1123 bp, Homo sapiens
ggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggccc

SEQ ID NO: 9478 - DNA, 1519 bp, Homo sapiens
ccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttg

SEQ ID NO: 9479 - DNA, 1170 bp, Homo sapiens
gcatagaattacttgttgcctttttgtctactttgccaaatttataacacttttgttcccttcttttctttctgccttaagccctattcatttttctttttttttttttttttaaagaaagaggcagggtcttgctatgttgcccaggctggtatcaaactcctggctcaagaaatcctcccacttcggcctcacaaagtggtgggattacaggtgtgagccaccgcacatagccatgccctattcttatagtactgtctacgatatccttgccaagttgtcttctatcaggcaatactgtagccataaacttgaaaaacagctaacaaagaagcttaggcatataataataataataattatgtgtcagtccactatattcaacccaagaccatgaataatcacctttcggaagacatttacaataatctagtgctataatagtcaatgttggtatgagatttacatttgtttccttcttcacagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacggtgtgtagaatggctgagtctcaacctgtcgtcattcatcctaaatgttgtagataacgtgggtgtggatccatgagagatggcataatgagtacttttcaaaaattggtagtatgagaatctgttctctacctgctttcgtatcacatgacagctatctgaagatgtcctcaggtataattaagaacaagggctataggatttcatttcactgtggtgcagcgaaactctttttatcaatagaaatacattttatacagggggcagtgataagcatagtaaagcaagtattatattgcaatgcttcccaaaagtattatgttaggaacttatttttgagagtatgacaaaaaaagaagtggtctccaaagacatgtaaacctcagaacaattgaatttataccagaaagttctcaataattttaacaaactctggataaataaaagctgaaaaatactcttatgttattcaaatggacctgtggatctcctttaactaatacatgttttgataaatatgctttttaaaaaaaaaggtaa

SEQ ID NO: 9480 - DNA, 1113 bp, Homo sapiens
accagccccacaacagagaaaacccctaataaatgggttaattttgtattctctagttccagtatatctctgctgatttccattgagagaaaatttaaaactgaagaataaaacttaggttagtttctgataaaactagataatgttataatgatgactgaaggaagatgcagaatgtcttttttggaaatttgtgaataaaagatgtggggtgactggaggagggaaaagaaggcagaatataagtaacaaagaatggataaaacgattctatttttgatttattaatttttttaaagattatttttaaaatttctttttttttttctgttgtagtggaaatactgtccttgagttgaggaagaataggtatactttatctggcatctaagttaataatgaaacattttacatgaggttttaatatttttgctcctagctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacagggtaaggactcttagatccagtgctttgctgacacaacaaagacttcacatttagggtagagaagtatttttaccatctcttttaattcctcttgaatatttagccatggtctatatatgctgtctgagaacataaaactatggtaattttagttttcttcttcatctccagcctcgtggcaatacagcttcactgatagctgtacccgctgtgcttcccagtttcactccatatgtggaagagactgcacgacagccagttatgtgagtgtggtttttggatattttgaagtgggaattattaagggtgggcagaggcacctattctacttcccaaaggcagtttcttctttatgaagatgaaagtaaccaggccaggcgcagtagctcacacctgtaatcccagcacaggctgaggcaggaggatcccttgagcctaggtgttcaagaccagcctggg

SEQ ID NO: 9481 - DNA, 1110 bp, Homo sapiens
ccgaggcgggtggatcacgagggtcaggagatcgagaccatcctggctaacatggggaaaccccaactctactaaaaatacaaaaaaattagccgggcatggtggcgggtgtctgtagtcccagctactctggaggctgaggcaggagaatggcgtgaacccgggaggcggagcttgcagcagtgagccgagatggcgccactgcactccagcctgggcaacagagcgagactccgtctcaaagaagttgccataaattgtgaaatttctagagtagattagtacgaagtgaacacagtttcataaacacctgagacaggtgagtgtagttaaattaacagtgctgactgtgtaatcttgattttttttttcttctactctgttataatatccattttaagcattagggtttttttggtgatatattttcacctttccctcccactggcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaagtaccattgaactcatgtcctctggttcatgacagtatacaaataagtgattatttgtacttaagcttgatgcttgagcactgtaaatattcctagattgtattttttaaaaaagcaatatagaggatgacacatcagtaacttcatgtcctaataataggaattatgtcttctcctcttgcaatctttaacaaattatttttaaaagtattctagatactactaactggcaaatacaccagtgcctctatcccttaaaccaggaggtaaaagctacagggctgtatatgttcacagtgatttttaaatggaatcaaactttctcaacaggtaatgaggattactgcattaaacgagaatacctaatatgtgaagattacaagttattctgggtggcgccaagaaactctgcagaattaacagtaataaaggtgggactgattctttataatttcagttactttgtaaataatacggattggagcaataactgtcctcatgttaccatcaaatc

SEQ ID NO: 9482 - DNA, 1104 bp, Homo sapiens
ataatcattggtcaggctggtcttgaacccctgatgtcaggtaatccacacgcctcagcctcccagagtgctgggattacaggcatgagccactgcactaggcctaccttcctcttaaatgggattcaatcactcctgtcttagctccaccctcagcctcacttccatgggtaattggtgctgccagttatatagtataggaaaatagccttgtagtgtaaatgtagctcagctttctcctctgccaaaatcagtttttattctaattggattgttacctcctgttctctttccagcttatcctctttccagaatttgttgttattgtgtcttttatagtagatttatgcctttaaaaatatctctttattatttctctatcagaagggctggaaggaatgtgtttcaacctgccagccataaccatagacttaactgaacttatttttaaaatacaatgtcttacaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggtctgtaatactaaaaacataatttaaagtcctgaagtagagagatttgtgctccatttagcaaaggaatttagtacaaaattcctgtcaatcttctagaaatagaccaattcaagtataagttagaagcattgataattttctcgttattttgaccaaagatctctttggtatttttttaactttttttggtccgttgtcaagcataaataaaagtagaattgtacaatgaactcccatgaactagtcatctatgataatcttagctcatggtcactcttgttttagctatactacccccactggatagtttttaaaacccagacacaatatgtcattttactcttcggtttgttcttaagaaggtttgctatggattttgatgataatatgaattctcaaaaatggttggaatgagggtattttaaatccatttattaagtacctattttgggccaggctcatgcttgatgcccttcatcatta

SEQ ID NO: 9483 - DNA, 1191 bp, Homo sapiens
tcttttataagtcattttctgtgatcttctctgtaaaatagggataacagtctctgctatgtgtttatcagaattgttatgaggagtaaatgaagtaatgtatataaaaagaacattagcacaaatgtaaagtcttttgtatggtggcattatatgcagaaattccttctaactcagctttagacataagacatttgctgattgaatatgtagcacaaacctgaactaatcatgtggaccccatttagatcacagctggagttcatgcaaactcagtaggtctacaaatttgaatgtgatagtccaaatatttcatcttttgttcttaaggataattcctagaattggctctattgatcacttctttggagagcttctccctttactgtaagggtgaggaacagtctactaaaatgtatgtcataaaataaacttagttaagcactgtaatacctttcaacttcctaccgaaataagctgccatggtagaggcagagaattattttagctgatggtgctttttgtgatttcaggtagacctgtttggtatagcagatttagcacatttactattgttcaaggaacacctacaggtcttctgggatgggtccttctggaaacttagccaaaatatttctgagtaagtattgatgaatgtcagggtctctgcctgtcccaataattttctgtttctcttgggtgctatctctgctttggcagccttagttttttaatccaaatgccatggttccagtagtttcagccagttttcattagagtatcagcagagcagctagtgcaggaaaaaggaactgcttactaaaaataagattcaaaactattcagacttcaggacatcattctgaatctagctgtatcttccagactacagctatagtatggaagcttccctgtttagatatgtgaaaagaagcatttcatgagaataattttctaactaattggtgttagccttaaattcctttttctttatttatttattttttgagacggagtctcgctctgttgcccaggctggagtgcagtggcatgatctcggctcactgcaacctctgcctcccaggttcaagtgattctcctgcttcagcctcctgagtagctgggattacaggcgtgcgccaccatgcctggctcatttttgtatttttagtagagatgcggtttcactac

SEQ ID NO: 9484 - DNA, 1591 bp, Homo sapiens
caagcttttgtaagtagagtggcaagtgtttttatctttttttttttcctgctcctcaaaatgttgtcttgttccggcaatcacttttgccttccctctttcctgagcctgtagtgacaaagcccggcgatttgggatgaaatctgttgtaacaccagagctttgattacacatcctctggttttgagttattctacagaatcagaaaggctggaaggtgggcttcacactcaggattgtgctttgagaaccagctaatagaccagccgagggaaggttgaattggctgtctttacttttcccgataagccctacttaaatgcagcctgtaattgtataaaggagatgagaaacatcaagagaaatgacatacatgtagctctggggtagcaagaactagacttcctcaatttggattccatttccttctgccatttgcttttaggcaattgagtgtgggtagtgatgagatatcaaatcccttagtgtttccattttgggaaatgaggcactatttttttttttaaaagacaacttacccacctgagtcctgaaacagtttgtctctccagttttctggcctatactctagttagctctgatccaagtttacaggacaacagccttgctttaagccatgtcctgttgtgggcacgataatagcaactgagctgtcacagcctaccagcaggctggtaacacctccagggtctcttggctagagcagatttcttagcagctgactaggacttcagtcattgggaagcctatgaggcctttacatttttggtgtgagatggggaagaaacataaaatgccactttacaacttcaataatagcctgtaatttatatttactgtgtgaatttttagtcctatattttaataatttgtaaattgatctcttattccaagaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaagcctgtgtaagttgatcatttctcttactgtgcttcgtggggacggagtagaggttggaagagtaagtggtctgaggtgtgatggatggatggtgatgaataggttgaggaggaaaaagcaattgccctgctgttctcagtgcctgatggcttgaatgaattgattagcgaagggcggcagaatccatcttagtcgggaagcaatcccggggtggaagaacagtgatctctagctcagccaccttttgccaaccttaaacaggctgagaaaaagttgtgctttaccagagcagatgcctagctgacaaagctaagggaccagtaagcatgaatattaagatttactgcaaacatt

SEQ ID NO: 9485 - DNA, 1174 bp, Homo sapiens
gttgatactccagtggtcttccttagtggaataggagcataatgttctgatgtgggaattgtgtttcctgttagtcaagagttttgtgtatgtgttgttttcttttggaatgtctttccatgcaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaatattctgactgtaacattgaggaatgaaaatagccttttaacctagatatgtcagttgatcattattgaactaatttagttaacaagtccaagatattctgacttaatctagaatatttttctgctactctttaagagtcctgtggctagtccctctgtctcccaagagcattggctagtctcctgagggtgttgcccatttgtagcagtggtttcaccaggtctgtggccacttgctgcccatgttttccctgcactcttttttttttttttt

SEQ ID NO: 9486 - DNA, 1127 bp, Homo sapiens
tgcaggcccacctggctggcaaggctgccctgatgaaccatggccatctgcaactccttgtgggccatccgtccagccatctcatcagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggtgaggcttcctgggcccaagatgtactggggagtctcggagacatggcatcccaggaggttgggctgttgatctgagcaggggtctcccttggggtctggctgctaactggaaggtagggggctttcagaagtgagaactcccgtagtctgtgccccaagccgaggagcattcccaagaacagggcccgtatagctctggacagccttgctctgcccaggctacctttggagattcttggcctggcagttaggtagcattgcagtggtacaggccacaggaaggcctctcttctctcctcattgggatacccgttcttagactctgaagagcaggttagatattggaattaggacttttaccaaattgttctcacggcccttctaccctccttgaggaaagctagaattccctagtttctagaaaccagtactctctgcatgctggccaagttcagcattcatgggaaaggtggtaggtaccaggctcagtaggtggtac

SEQ ID NO: 9487 - DNA, 1167 bp, Homo sapiens
tcctgattgctatagggagtaatatcaaggggctgtgacgcaatgttatggaagccgccattttgtacggaagccaaagtccaatcacttccatagcaagcaatcgaaagaagatggccgctcccacgattgtgggggaggtctccactggggaggggcagaggaaattcggtcgaaaaagagataaagctgaaggaaataaaattggcacggagtctgggaaagtagtttccctaaaggagtcttagaaatagggttggtctggaacctaaggggcggagccgacgcgtagagccgctttgcgcgtgcgcatcacctaggcggttagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcaggtaaagagaatgactctttcgttctgggcttcagggaaggcttcgggttttgtctgggcgccctgaagttcctgcggtgggaggtagggtacgctccctcagcctggcggcctccgttagcgccgggccgagtagacgcccctgccccgggccgggcacactgtgccctttttcccctcctcggcctgtacgttgtgccgcctcccgcttccctaacacttctccgcctgcacctcggcccctccggccacccggctcgggttgcttgtccgtcgctctcttggcgtcctcttccgccccgccctgccgtcctctgtcagggctcgcggactcttcttgcacccctgccgctcttccctagggacctctcggctgtttgtatttctcacttaagctttttttggctctaaatgaagtgacagcaatgagtgattttaaaattctcagctcttcgtggtttaaggtgtctgctcggagtgctggccgcacgtaacagatttttcgttttctgcaagtataataaccttaacaaatgaagtcaatattagtactgcgcaaattagtttttaaaaatcctcttctgttcattattcctcaggatttaagcccttattcttcacgtttatttaaatactcaagtttgagggaggaaaaagtattgccgattggaattttacagataggtttaataggcatt

SEQ ID NO: 9488 - DNA, 2023 bp, Homo sapiens
tgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggaggtgagctctgtcttgaaccaaagaatgttcttgaattttgggttttgttttgttttcttaaattgtgggtattctcaaattttaatcttagtctcgggtaggcagaaaataattatttccacttagagggctggagaaatattcttatgtagaaccttcagaaattaattgactaacagctagacttcaaagcaatttaaagtgacaaatagtcacaaaaaaattaaatggaaaattgtacaaaaagtagccaaagttaaaattgtataatttcaaaaatttcaaaaggtatgtatactgtcacctctagtgatttgtcaatttggctttatataagaatctctagggaggttatatatagcttgaaaagtcatcttcagtgttgttatatttggggagtaaaaagctttttattttgccaactgcatgaagtaaagcttgactgaatttccttggctgacaaggatatgtagaagttgagagtccattttctttattatttaattttatttttattttatttta

SEQ ID NO: 9489 - DNA, 1129 bp, Homo sapiens
tgcaaaaacaaagaaatagaactgaagagctactggatcagttgaggtaaggaaatgcaggcatcatttgtttgtgttttattctgtaccttgtggttgtttaaaccgattggagcaattgatgtatttttaatgtgttgctgtttttaacctatacagtgctgtttcaaaaagagtcagtgtactcaacagtaagctggaaatagagtagaagaactatggaattataatttttccatattttatacttttcattgcgtagacttggtgtttctctgatatacaactcaagattgggttcttagttatttcaaaagcttaagtttgtacatccacaatatatgaattgaaatattttctcccagtccagtggaaaaacattagcagctgctgttggtactgtttgggtggtatcagaagttctcttttatgttaattttaaaaacgctttttaaaaatcttgtttatctctctacagcttgtctgagtgggatgtcgttgagtggagtgatgatcaagctgtattcacctttgtttatgacacgatacaactcaccatcacctttgaagagtcagttggtaaggagccaaagtgagataattcttttacagaaaaatgaatggctacactcactaaagattcaaatctttattttactatactgataactattggcatgatgagagcactgctgaaagtcttagaacagtcactttattgatagcagaattttattttattttgtaaagaataaaataaaaatggaattagtgaacgttgccctttgttgaattacattaaataaaaattttgctctgcaaataatggataaacatgctactcatgtctatttactatgagtttctttcttttcatctccatctttcgtgatagagaatagagaatttaccctaatggctggagattctttttttttttttttttctttttttacttaagagtgaggccctgcagctcacgcctgtactcccaacactttgggaggctgaggtgggcggatcatctgaggtcaggagttcgaaaccggcctggcccacatggtgagaccccatctctactaaaactacaaaaaatgagctgggcatgcacctgtaatcctagttactc

SEQ ID NO: 9490 - DNA, 1342 bp, Homo sapiens
ttagtagagatggggtttcacagtgttagccaggatggtctcgatctcctgacctcgtgatctgcccaactcagcctcccaaagtgctgggattacaggcgtgagccaccatgcccggcctaaatttttctttttttaatgtttgtttcaatatggacaatccactgagaggggccagggcaaaaatggattctgccaggttggaaatgcactaaggaaaacagtacagaaacattcccagggtccttctaggaagaatatatgtctaaaaaattttcagctctgttacaaagtcaggaacggaattgtttaattataataaattggtgctttggtctgtgtctttgggtcagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactg

SEQ ID NO: 9491 - DNA, 1225 bp, Homo sapiens
cccacccatgttggttgtggcaagtgtctctgactgataaggcaaaaacgagcagggacttctcacatttgccttaactgtcacagggcctcagctggttgtctgctctttccttcctggatcattttcccagcccttagttcccataggaaactttctctcaaataatgatttctgctgggcatggtggctcatgcctgtaatcccagcactttgggaggccgaggtgggcggatcacttgaggccaggggtttgagaccagtctgggcaacatggcaaaaccccgtctctactaaaaatacaaaaaaattaggtgggagaattgcttgaccccaggaggtggaggtttgagtgagccaagatcgaaccactgcactccagtctgggtgacagagcgggaccctgtctcaaaaaaaaaaaaaaaaaagaaaaaaagtctgcccttaagaggtatgaatgattgtgatttggtgctttggacaatgccatgtagagtgcttctttgggggtgagggatagacagaccctaggggctctgagctgaataatcctcttgttgtcccttacatttctctgccagttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtggtgaggctccagctgcctgtctccttctccttccctccctccctccatctctctgttcctgacccctggggaatgaaggcccgtgtggttactgcccctacaaggtgacatgggacgagaaatggtgagacagctggttttgcatctgtcccccaggtcacatatcctcttccaaggaggcccagcgtggatcctagggccagtgtactgcttgccccagagctgcctcccctcttgggagggggagtgtagttctctgctttctgtagagctactgcagaaagagctctacctctcacctctagggggaaatgtggaaagaactgtattttttttttctcctcatttcccttgaggcaga

SEQ ID NO: 9492 - DNA, 1247 bp, Homo sapiens
ctgggaattccccaaagtacccctttgcaagccgtgcgcgtgcctgtggctggcattctctagagctgccttccttcaccagggattgctccgggtagctgtgttggcagactgagccacgtcctcatttctgctaaggatttgcctggtctttttcctgagttatactctatctctacctatctcttcctatgtggccagcccctgtatgcgcctcccctttgctggtggctccaggccatggtctagacagcgctgtccattagaactttgtgcagcgatgtttacgtccattctgcactgaccagtgtggtagccattaatcatgtgtggccaccgggcatttggaatgtggaatctggaataacggtgcagctgaggaactgaactgttaattttatttatttcaattcagtgtcatgcagtgagtggccaccagattagacagggtcaggccttctcccctttcttcctgggccttcccactttcctcttctgcctgggttggactgcctttacccaagcttgtcctgtgacctctctctgttgacagtggcttccaaagaggctggcatggggcactcatctcttctgctcagtctgtgtcctcccactccctgatctgaccccgtgccaccttctggctctgccagcctctacctggttcctgtagtgccgcacagagcctccctttcccggcacagcctccctttcccggcatagccagctttcttcagggtcctgccaggaagggccgcccccccaacatttccagattgcctctgtccctccactctggggtgcctggaaggactgtccaggacccagagagcaggcagagccctggattcctatcctggaatcctcccccaggatgaagaagctctgcctgcctgaaccctccagcgatgggcctggagtcctgtccctgtcctttccttaatccccagcctctggatcttccagtcaccccggctttgcccaccctcaccccatttagaagctgggctcgctaggaaactgctcccttagcatctgcagaacttcctcaagaagtgaaatccccaggtccactttgaaggagaggaagggatcactgaggtctggggtaggtgtcctctggaagcagggagtgtccacaaggcccttctctgagtgctggtggagggcactcgacagagagagcgccgatggcagggtggcagagtaggctgctgtgtaggcaggtgggggctccaggatgttgg

SEQ ID NO: 9493 - DNA, 1196 bp, Homo sapiens
tttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctatcctctcttcctcttcccccaagattgagctctctgcccttgatcagccccaccctggcctagaccagcagacagagccaggagaagctcagctgcattccgcagcccccacccccaaggttctccaacatcacagcccagcccgcccactgggtaataaaagtggtttgtggagtttctggctctgttctgtgggccaggagagggactaggttgctggggggtgatgggaccgtcctgttcagctggttcaggcttcagccaccctgttgagcaggttttcccatcgtctctctcgaaactggcctggcccctgactttggagagcagtgccatgtttgaccaccagaggggaggagtgagcgggccacgggagccacgagtgtggggaggctgcagtgctgctgtgtagcatttcttcctggtgtgagcctctccacaagcctgttgagtggttgagctctccacaattctgctcatttggaggttggggttaggggtgcacaggcaccttggctcctacctccatgttagggcccaggtgactagctgtctccctcccaacagaagccctggcttctgcgctggagtgcagcacccccaaccaggctctgagctccttcccaggagcctttagtagagacacgccactccaacccacacccctgcatttgttcaagctacctcccggtgccaaaaaaaaaaaaaaatcatactttgagctcattcgttcgtttattcagtgaattacattgagctcctctgtgccagacactgccaatcattagaaatttgatactgctgagaggggcagaggaagcactatttaaatgctttacgtatctcgagttgctggcgctgcacacagcccttg

SEQ ID NO: 9494 - DNA, 1435 bp, Homo sapiens
gaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaattgaggt

SEQ ID NO: 9495 - DNA, 1198 bp, Homo sapiens
ctcctgagtgtataatagcaatgagaaggggaagccatgcatgcagtactcttaacagcaatccacggcaaaatacaggggaatgaaaagaaggcagccacagcagttgtaggtcaggaggagagggaaccatggtcctgctgataagttgcctgtctgtattcaaaagggaggagaagaatgaggaaggatttggactggtgacagagagctggcagtggccaaggcatactgggggtcactgagcagcttaggttccatggaagaggagcagtaggagtcaaggttgtaaacacatggcgaggcctgctgggcaggagcttagcagatgtgtgacaaggggctgcagacagtttgaggaaaaaagtggctgttgtgaccgtgatatgtgaaggatgattgtagctataaagtacaggacatttgagtgtggtgagaaagagagagccacttacagacctttcttcccattcaatacgtgggcttagtatgagctcatagttgtagcaagtaaaggcatactagtatagaaagtgcttggagtgtagtaattgctcagtaattgttagtttacttgccttttctcttactgcagaaatctcagctttcatttattggttcttccaggaaatatgaagtatgatagaggaaatatgaagtataatagcctcgcccagtgtttcttagccctttgccaacttaccacatccttggaaaacaacagtcatgccagtagtccaggctgccgtggcagggtctcacccatggctggggcattgcatatactcatcagggtttctcctcagaacctgcactgtgtagagggcagaaagggtgagggagatagagggggtagagcagcacaagaaaaaccaacagtgcttggcaactggaaatggaaatcaagggaaaggagtggttcagagagtacccgtggttccactgtggatgaggagagagacatgtctgcccatcaagcacttagaattcttttttggaaagtaaaaccagtacatatgaaacaattgaagaatcaatgtgttatcacatgtaagtggatttggcttatgtaggaaaaagggaagttcactgttgcccagggagtcatcactcaagatgggggatttgagctgtgcccttgaagtgacacaggccttggagagcaggggtggccattgccagcgcaaggagaactgta

SEQ ID NO: 9496 - DNA, 1227 bp, Homo sapiens
tcccagctacttgggaggctgaggcaggagaattgcttgaacccaggaggcagaggttgcagtgagctgagatcgcgcctctacactccagcctgggcgacagaacaagactacgtctaaaaaaaaaaaaaaaaaaaaaaaagagtgttttggaataataacattagtccccagactattataagtcatgattcttagagaaaaccaggaagctaggaatggtttgatttaaaaatatgacagtgagagaggtctgtacatctatggtaacatttttctgttatatttgctacatgtttatacttgtgttgcctatcagtcatctattagtgggcagcaaaagtttatctgcaaattggaagatgacctccatgtttggttgtaacaacagagcaacattgtataatgctttacagaaatacagtcaggcctaggtaaccaccaaaactctttttagtcctagactttatgttctgtattcagagatctctctctattgatacatgccattttttcttttcagtttttcctttaacatatctctcccttttctgcaggaatgacatctttgtgttcctgttaagcacacgagctggaggactgggtatcaatctcactgctgcagacacagtaagtaatgagagcacaatcaactagatatgcaggttttctactatgaaacctactatgtaggtttttctaatatggcattgtttgttttaccctttgcttttgtgtcacaaacttgcaaactttttatttctttgcctcttgtgttaaaagactctagttgctctttgactggaactagagtattttagctttccttatggactttactattcattttctttgaacaagtttttttgtttttgttttttgagatggggcctcactctgttgcccaggctggagtgcagtggcatgatcatgggtcactgtagcttcaacctccccagcctcaggtgatcctcccacctcaccctcccaagtagctgggactataggcatgcgccaccatgcccagctaatttttgtattttttgtagagatggggttttgccatgttgcccaggctggtcttgaactctgaggcccaagtgatccacctgcctcagcctcccaaagtactgggattacaggtgtgagccactgcacctcgcctgaataagtgtcttacacattcattcgacaaatatttcactaatgcctactatgtgtctgata

SEQ ID NO: 9497 - DNA, 1198 bp, Homo sapiens
cctgggtgacagagtggaaccctgtcttgaaaaagggaaaaaaaagagagaggttataaatctctttgtttacttttctccaaaggcaggtaggatacgttctcaatgctttcagaactagcagaaacagatatctagagataggatgaacaaagaaaaaacaaaattttcaggtcacttaacagcagattgacatagatgtcacccatagatgtccatgtatacctggtgtcctctgagtaaggatgtggagcagggatgcttttaagtgccttaagagcacatgtctgattgggagtgatcagggaatctgcacttccccctttggggatgttttttcccagggcactcctggagtcgtgatattttcagggcgttgcattctccctttagagcacttttctgatctcatgatgacaagcatcttggttttagtgattgtggttgcatacagctttgcattgagtgattttgtcgcttcaattaaatacagttccccctcacccccttttcttctccccaggcaaggagagcctcatcactgacagtggaaagctgtatgcccttgatgtcctgctgactcggctcaagtctcaagggcatagggtccttatctactcccagatgaccaggatgatagacctactggaggtaggagagggaatcttggggacctaggataccttgacatttaatttgtaggaatcagatgtccatgactaatgttagtcctgcttaatgggagccccaaaactcccttttgtcttttttctttttcctttttttttttttttgagacagagtctcactctatcacccaggctggagtgcagtgatgcgatctcggctctgcaacctctgccttccaggttcaaggaattcttctgctccagtctcccgagtagctgggattacaggcgtgcaccaccacactcagctcttttttttttttttttttttttttaagtagagatggggtttcgccatgttagccaggctggtcttgaactcctggcctcaagtgatccacccacctcagcctctcaaagagttgggattacaggcatgagccaccacacgcagcccccaaaactcctttttttgattttacaatctataaagggagcagagttagctcctggcatggggagtatgtgaaggacttctgccccctgccctacaccagtgaaatagaaca

SEQ ID NO: 9498 - DNA, 1152 bp, Homo sapiens
tttgtcagtcagcaacctggtcagggaagaggagaaagctgttgataaatttgggagctttgccacaaaagcattaaagatgacttcaaatatgccaggccaatattctttagtttttaaatgaagtctgactagctgcagctccctttctggcatcaccatcatgcatatggttaagagaactttgccaagaacaatatctagcagtgaaggggaggtggcaaaatgatcagatatatatgcatataatagagttattgctgacctggtattctcatttatctgcaaactccagctctctttggatctttagtttgtttgcaggtttcattttataagaggttggctttttatctggaaaagctcactaagtcattcattagggacagcttagtgtgccagaacagatatttaaaaccactagtctaagaactatccacattagtctgatttcaaagttgaggttcccaaaaggcatagtgtgtatggacaacgtgaaagagccatctcatgtgaatctttaactgcaggttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggtgagttctcaatcctcttggaatgtgttcctcgctttggcaaggggagaaccagggttatcttcatgtggtcctttcagatatttggaatttactgttcttgaggtttctgcttccttttttggccttagtaattcataggtaagaatattagtaatttatgatgagtggagagagaaatgtttttagatttgtgcttaaatacactcctttgacatgcttacagctgagaaagaaatgccactcttaaaaaaaaaaaggtagaaataaacttagtaggaaaggctctaggttgaatgagtacggttgtcttgtgccattgccagtggaatgaatgagaatgtcgtcactcacagaaagcctcatttaaatagcataaacagtgtcctacatgaa

SEQ ID NO: 9499 - DNA, 1127 bp, Homo sapiens
taattttttgtattcttttttttttgtagaggtgaggtttcaccattttggccaggctgttcccgaactcctggcctcaattgatctgcctgtctcattctcccaaagtgctgggattaaaggtgtgagccactgtgcccggccaaggtgaatttttttttttttttttttttgagacagagtctcgctctgtcgcccaggctggagtacaatggggcaatctcggctcactgcaatctccatctcccaggttcaagcgattctcatgcgtcagcctcccaagtagctggtattacaggtgcctgacaccacgcccttttgtagttttagtagagactgtattttgccatctaggtcagcctggtctcaaactcctgacctcagatgttccacctgcctcggcctcccaaagtgttgaaattacaggcgtgagccactgcgcctggcaaatttttttaaatactgataggagctttgcggaggattttagttttcatagtagcaaaccatgtaatgcgaaataatgtatctgaaagtaggaaagtaggaaagaactgtttctaaaatgataaagatttacaaaagagttatgttaatgagagacaatccttgctgctatgaacgaccctcaaacctccatggagcactgaataagcgtgtctgctgtggtttgtttcagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaaggtaagcaattatttgagcataaattacctacttagtatcttctttccttttccttgaataagtaaaaataatagtaaagtaaatgaaggcctgagagaaccaaaaagttcccagaggagtgggcggtgcagcatattgagttctaacttaatttacactttgtatatatatttttgagtgtatttatattttcaaaatgttttttttacaatactgtgaagtacacagatcttaagtgtacagctctgtgaatttatatatgtgtatacacttgtg

SEQ ID NO: 9500 - DNA, 2945 bp, Homo sapiens
aaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaatttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaataacttttgtccattttacaagaattttatgtaacttagtcccttcaagtttgaaatcacagtgtctcccttactcaagtttatgtctgtacggtcagctgcagtctactctgctgctgcctggatatatgaagtggaaacattcatcgaggggccagcacttttggcttcgacatggttttgtcagccgtggccacttcccattcattccagctaagacgcaatttctattcttgactccctgactccttaaatgtagaaaaagcctaaaaatccagtatatgtccattccttaaattgcccacctcctcattcatgtgcagcctcagcggtgacatactctggttttacatggctttttctttgcatttcttttttgagatggagtctcactcttgccca

SEQ ID NO: 9501 - DNA, 1580 bp, Homo sapiens
tctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaag

SEQ ID NO: 9502 - DNA, 1096 bp, Homo sapiens
aaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaa

SEQ ID NO: 9503 - DNA, 1145 bp, Homo sapiens
tcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaag

SEQ ID NO: 9504 - DNA, 1099 bp, Homo sapiens
gattttttttttctgacaggtccatcaataaagtatcaagagattatcggcaatattacaaatcactggagtctgtttggggttttccagaagctgagccaattatttacttaattgtctaacgattaacgacaccccttgtgctttctgggcctgagtttcgtaatcgacgccctgagaggtatacagtaatttcaaaacaaaacaaaacaaaaaacaataaaccatccctcggaatagagcttatcatgtgagcacccagacaagccagcttcaaaatgaggtgaaaactacagttcctcttccgtttatcagagttctaactgggactaccgtgaaccacatctactgcccgaggggcagggagagctgcctcagtcccgggcttccctctcggtcccttcgcaccgcatctccccgaggccgctattcccgccgcgcccgcccagggacccgcaccgccagcgccgtaccctcaggttggcccggagacccagactcttggctaagttctgcaggtcactgtacttgagggagtccagctcctctagagaggggatgatcatcgcgattcgaaatcccggcgatactcggaagatggatcaccaaacttcgtcagcgcggttcaaatccctggcgccactcttaactttgactaggcagaaatttatagacagtttaaatgaagaatgccgcgcttccattggttgaaaatgcctcaaaggcggggtttctaaccctgaccaatagaaaggctgatttcccgtcccaacagaggcgcgcttttttcacacttcacgaatacgcaggcgccaaagggcctgtaacgcctgttcaggtaacgagtgcgcggactcggactccagtgcttggattgcccatgatgtccaatgaggacgcaggagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggg

SEQ ID NO: 9505 - DNA, 1105 bp, Homo sapiens
attttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcatagattcattctttgtaaacataagtcttccaagatttaggtgagcagctaggcttaacaagagtttatacatacccttggtatgccctttcctgaccactgcttccattcaaaaaagaaacggcagtatgcttcctttatattcccagagtacctctcaggttttattaaatgctgttttgtatatacgaggctttaggacatggcacacttccgggtactggaaacattcagattttcctatcaa

SEQ ID NO: 9506 - DNA, 1205 bp, Homo sapiens
tgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaagggtaggtgaggcccaggagccatcgttttctagtaaacaggggtgaacttcattgtagcataaactatagaagatagcttttgtttctgtaaatgaaaacacctggcatgttatatttggcacctcacctgtgtctggggataagtaactattggcacaagtgtgaagtggaagcacaagggggaagtggtttctgaggaggaggagttaacttgtttctgcgcattgctttgggccaggaacgagcattgttatgtttcaggaatcctgagaggttagacatttgaaagatttttggagagattttcatctcctctaaaaaagaccacaacctctgtaatgaccaggggttttgtagagtggatgtagggttagcctgtggctttctttttttttttttgaaacggagtcttgctctgtcgcccaggctagagtgcagtggcgtgatctcggctcactgcaacttccgccctccaggttcaagcgattctcctgcctcagcctcctgagtagctgggactactggtgcacaccaccacgcccagctaatttttgtatt

SEQ ID NO: 9507 - DNA, 2576 bp, Homo sapiens
agatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataaactgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgcatcacactgtagccactttgccaccacctccccacatgtagccgctgaaacccccacgagatgccaatgcacacagcagggagaaaagccaaccaaagaagaccgaagggtatctttccacccgagtagcctctgtagtgattgggaccaagactaaggacttgtctccaatctcagctgaggcagtgcctctgaaccaagatcttggtcaggcattaagacactggctttgtcctaccaactaggatttcttggtggttcacactatttcttgtgctggggaattccctcattgggcccctcctccctccacagtgtggtttcagtgttgaagggtgcagcacccaaggttgtttttatgcattttttcagttccttccaagaagcaaaaaggccagtgtccatctgcctagttcataatgtttataggtctgtttgtctgtcttgcttctggcaggtgtagggaaagtctactgcctgccactcccttcaaaaagaatgtttttgcttttgtgaagtcctgacttgccactcaaact

SEQ ID NO: 9508 - DNA, 1123 bp, Homo sapiens
acggagtcttgctctgttgcccaggctggagtgcagtggcgcgctcggctcactgcaacctccgcccctgggttcaagcgactcccctgcttcagcctcccaagtagctgggactacaagcacccaccaccatgtccagctaatttttgtattttcggtagagatggggtttcaccatgttggccaggctggtcttgaattcctaatttcgtgtgatccgcctgcctcagcctcccaagtgctgagattacaggcgtggcccactacacatggccaatttcatgctttttaatggctgcttctcagttcccagttttccccaacatctgctctgtagtctttaaccctgatccttgtgctagaaggacagatgtttgtctaggacctgatctctgccctcatgatttggtttcatgtgatcgttatccacacaccttatgtatgtatatacattcctaccctccccctcagcacgtcatttcccctgtcacagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagtaagttacatctccatcttcagaggaaggaagggagctagcaattgagctgcctctgggccagctggggaagaggtaagtgtcaagcaaggccagtggtgggtaccagccctcggctcagtgccacctctccctgttctgcttctaggatgaggtcaaagctgcccgcaggagtatgctgcagaaaacatggctgctggcagatgaggtagggtcagggccattaggagggtgggatattagaggatcttgggggacagagaccacaacaggatctcattacccacttcataagttttctttcctttctgcagggtctccggcagcacctcctgcactataagcttcccaattccacgctcccagagggctttgagctctattctcagttgccccctctgcgtcagcactacctccagagactgacttcaacagtgctccaaaatggggtat

SEQ ID NO: 9509 - DNA, 1202 bp, Homo sapiens
agcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccaggtactttctcagcccagcaggacctgcaagggtaccctgcactgggcctcgggggcagtcctgagccttgaggagctttggaagacctcagcttcctcatcttacctcttgggggctttgaggggattaagagaatcaatgaaaagggcttaacatgggctgggtgtggtggctcacgcctgtaattccatcactctgggaagctgaggtgggtggatcacttaaggtcaggagtttgagaccagcctgggcaacatagtgaaaccccatttctactaaaaatacaaaacttagctgggcgtggttgcgggtgcctgtagtcccagctactcaggaggctgaggcaggagaatcgcttgaacccgggaagcggaggctacagtgagccgagatcgcgccactgcaccccagcccagtgacagagcaagaccctgtctcaaaaaagaaaaaaggaaagggtttaacctggtgtctggcatatagtgggtattcattactattaa

SEQ ID NO: 9510 - DNA, 1938 bp, Homo sapiens
tggtcaggctggtctcgaactcctgacctcaggtgatctgcctgccttggcctcccaaggtgatcccacctcagccttccgagtagctgggactacaggcgtgtctaccaagcctggctaatttttgtattattatagagacagggttttgccatattgcccaggctggtctcgaactcctgggctcaaataataccccccttcggcctcccaaagtgttgagattacagatgcgagccgctgtgccccaccagggaataaaattttttaaaaccctagtgccatatgatgaaggggcccctgcttttgagggaagggctcctgccttttctcacgcttctctccaccccaggtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaagacctaaggttttgtctctttttttttttctttttttttgagacagtctcactgtgttgcccaggctggagtgcatggtgtgatcttggttcactgcaacctctgcctcctgggttcaagcgattcttgtgcctcagtca

SEQ ID NO: 9511 - DNA, 1852 bp, Homo sapiens
tgaattctttatattgaaagtgagtttttcaattttaaagttggaaaatcatctggcaacatcatgactatactaaaaaccaatgaattgtatactctaaaattgctgcaatattatgttttatgttatgtgaatttaatctcaaaacatacaggaaaatatcagctggcagtttaatggccctttccggtttgtgttgcaattcttagttgtgatggatgtgtgttcgctttacagggttgttaatcaccgtgtggatttttagagtttttgagtgtttttgaggaatggctcaggaaatctgatgtgttacttggattcctaacatctttttttttttttctcttcaagtcttgttaatggatcattttgtacttttaaaatccctttctcctctctctctccagtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggtaagattgtaattttcaggattctttaaggctaattagtcatacttgaattgtatactggcttgtaagtaactcgatttacaatctagttttgtgatatctatttgtgagggtgtatggggggtggagttgggagggaagtgtctccaaaatgtttggtttagttaataggaataacttaagatacttcatttgaatagacttaaaaaagtatgtcttgcttagatttcagtttacgatttttgcatagctgtgtttaaaaaaagtcttcgggtcttactggaattttcatcattatggattttggaaaggactaaaaatacatgaaatatttactaactctttggtgacgctccatttcttttacctcctggttttcttttatttttcttttcttttttttttttttttgagacagagtcttgctctgttgcccaggctggagttcagtggcacgatctcagctcactgcaatctccgtctcccgagttcaagc

SEQ ID NO: 9512 - DNA, 1880 bp, Homo sapiens
aggcccgaggcaggcagatcacctgatgtcgggagttcaagaccagcctgaccaacatggagaaaccttgtctctactaaaaatacaaaaattagctgggtttggtggtatgtgcctgtaatcccagctactcgggaaggctgaggcaggagaattgcttgaacctgggagacagaggttgcagtgagccgagatcgcgccattgcactctagcctgggcaacaagaaagaaactccatcttaaaaaagaaaaaaaagaaattggcacaaataatacaggtaggtagtacctgtaagaaattgacccagtagtgcacagtaaatgtcggtaagcacagtcactaagaggataaaatatgagaactgaagatttttgacctgcaaatttctgtttgcagcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccaggtaaggcctagatgttactagctgctttattttactgtacacctatttatataactttgtggttgtgttaggattatagatatatcaggataacagtataggtatttctgttgtaacatgatacatgtattcctgaaaacctctgcatgctgcaaaactgaacactaaaattaatagagctcatggttaatacgggattgcgataaatcactgaaaatatatgcagttttataagcagaacattaataacaataactgataaccttgagagataacttgaacaatcttgactgatagtttagtggagctggagattgcgactcaaaatactaaaaaacattacaatggaagtggtggctgaaggatactgaagtaatgcaggtaagactggagctctgagccactaacatgggcatgggaggaaacatgacctgtgtgctgagagctaggggtgcacatctttgaggagggagcctcaaatgcagatgttccttttgtggggtgtggggggtgctgctttttaattagagacagatgagcagacttcatctccttttgtgtagtaaaaaccactaatgaatcagcacctatttaattgctggacatgaactgattgaaatagaaacaaggaggcatatttgtttagggctctaatatttttataaactttttagttaaaatatttcttttattggcttaggttgagtgaatttgaaataggaatatcctacactttgtgtagtttttatatccagatgcaactagctaaagtaagtggttcttttaatctactcatagaggaactaatatggaaaagagcaagagactttgcaggatttgaggggaaataattaa

SEQ ID NO: 9513 - DNA, 1645 bp, Homo sapiens
gtcaataatttgaagaactgatatttctttcatctttttgataaaagtagagtgctgaatttagactacaaatccctaagatggttatatgatatgacagagagaaagagaggtgttaacactagatctaaatgaatttttctttttttaatttttgtttttcagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttac

SEQ ID NO: 9514 - DNA, 2183 bp, Homo sapiens
cttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaacttggtgttgggaggtttgtgccaacttggagtggagaattctaattccctaagacatatttgagagaggtgccactgaagtggttttatcataggaatcctttccttttctctaagtttctgatatgccatttgggggaggttttcgatgttctaatccttgtagcatgttttacatggaggcttcaaaattgtgtgcaacctgatggcaagtatttgttttagaagtcattctaaaatcattctggtgtcagtatgagcaaggcagttcacctgttaaccttggggagtaaaggtacacaaaca

SEQ ID NO: 9515 - DNA, 1114 bp, Homo sapiens
gttattgaatttgaccaagcctcagtttcctcacctgtaaaatggtgtacttgattcacctaattgttctaagaataaaatgaaataatgtaagtgggagacatagaagagtgcctgatatatagtgggtgcttccccttggtcatgttgaagggtatataccagttatgtatggcctgtgacaggcactgggctaagtcctggccaccattccctttttcgtcccattcccttccatctccttgggtaggcagaggactgctcccgaatggaggtctgattgtgttccctcggcctcttcaggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgtgagccctgaggctgtggggccccgcttcaccctcagtgcccccatccccacagctattgcaccttgttactgggaactggtccctaggccttggccttccagccttcatttggctgtgctctgtggtccaagggtttgttttgctcagctttcttgccccttgcagctgtactggtcaggcctgcctcatccaccttttctaacctgttccactaggacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttaggtaatgccaggccctgggtgggtactgactgcctctcatggtgcagagttgggtatttagaactttagggagggtttggctcaaaaagattgggcaacaagatacttatttacaaggcaaagataataacttcacaatgagtaaacctagcagaaatcatcttcaccaagtgatcaaggttaacatcctcatatcaacatcattaagcccatgataggatgtactaagaaggatgtgacaatgtttctgtggtattcttaccaaaaatgc

SEQ ID NO: 9516 - DNA, 1122 bp, Homo sapiens
tgtggtgggggatccatctccaccagaccatttcagcggggagagggaggtgccctccaggccacgcagcaagatgggttctgtgggcagagataccgtccccagcctctctgctctggttcctgtttccagcctcagagcacagagttcagcttgtggttcctgggtcctgtgagggtccgcaggaggcctctgtgggcactggcaccttccgcttccactgcccagcctgctgggagcaggagctgagtattcgcctgcaggtagtgtgcctcgctccctcgaggtggggcccccagaacttcctccctccctctgcacctcctcccagtctgacctctgctccacctggcagagtgggcaccctggcagcatgtgtgggcccatgctggcctccccttcccgtccctcccataactctatggctgccggcgggagtttggtgaggtctttgctaggagtggaagcgtaaagattcttaggtctgcattctttgtcccctgcaggatgcccccgaggagcaactaaaggcgccactgagtgccctgccctctggtcaagtggtgaggcttgtcttccccacgtcccaggtactggcctcccagggaaggaagcaaggcgcctggatggggctgggacccaggccacaaagggaggggcctgcttcccgcttctccgtgggtcacaccctgagcaggtgctggggccaggctctttggggagtgtcctctgagcatccctgcttcaggcctggcgcctgtggagacggtggcggggcgggggtggtgcgccggggatcagggtaagaggaccagagctgggtggaggtggccgaccttttgtgactggggccttcacggttttcaggagcccctgatgagagtggagctgaaaaaagaagcagggtgagaggcctggctggggactgggcaaggccctggaaaacaaccagggtgcggggctggaggaggcctggaggagtgagggggagaaacagccgcccctcatcctcatgctctctgaaggggctcaggcttgcgctcgagggggcacgaagtactgggaggagtactgggaggagtcttagcacctatggtcagaggggcgagtgaccggcccagt

SEQ ID NO: 9517 - DNA, 1122 bp, Homo sapiens; identical to SEQ ID NO: 9516

SEQ ID NO: 9518 - DNA, 1218 bp, Homo sapiens
cagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaaaattagcttttcttactggtttttccaataagtaatagcaaagcccacttatcatacttaaactacag

SEQ ID NO: 9519 - DNA, 1507 bp, Homo sapiens
taggaaccatttctctaaacatttaattaacataaagtactcgtggaagatgtttgcttggatagtctgtatagaagatatttggaatatagatcattttaacctaatatacttcaacctttttttttttccctaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactg

SEQ ID NO: 9520 - DNA, 2320 bp, Homo sapiens
gacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattgacggtttactttcgttaccttgtctgcatattcacggccagccctttccacgttggcttagcgaggaagaaggaaactgggtg

SEQ ID NO: 9521 - DNA, 1794 bp, Homo sapiens
cagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagt

SEQ ID NO: 9522 - DNA, 1277 bp, Homo sapiens
gatggcgccattgcactccagcctgggcgacagagcgagactccgtctcaaaaaaaaaaagtggagaatttgagacttactgaaattacctaggaaggtaattctaaatagagatttttggaaacagcatgacacatagattgcctaaattttggatgacagaaatagttcctgggtcggtgtcagggaatatgcactagagtttgaaaaaaaaaggttcacccttcattattattaacttacaggtggtgaaagaaagcataaaaagagaaccagtttctaattaggatggagatggtgtgggttgaagttataaatgagtttataatgtaagcgtttgccctcctcagatcaggggatgggggaggttcagtaaaaagggttggagtgggaaatagcggagatggataagttaaggctgcagagtgggtatgaaaatttgagtacaggtgacagaaatgagtttgtaccaaggtaatgatgttggttagttgaattttccagctaagttggttttagctgtaatcttggcttattttccagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggcaagtacagtgcaagagaatcggagttgtctggcacaaatagaagggttttgaggccaggcgaggtggctcacgtctgtagtcccagcactttgggagggtgaggcagggggatcgcttgagctcagaagttcgagaccagccagggcaacatggcaaaactcgatctctacaaaaaaatacaaaaattagcgggatgttgtggtgtgcacctgtactacttatgaggctgaggtgggagaatcacttgagcaccaaagatcgaggctgcagtgagccatgattgtgccactgtactctagcatgggcaacagagtgagaccttgactcaagcaaagcaaaacaaaacaaagaagggttttaaatggcatttcccgtgttgtctcatgcatcatttagaagcaccaccttggaaagagcaaggagattgcaaaccttttctttacaccaacatcaccaagtgatgcactttcatttgagaaacaatgagtgtattttgttatactgtgggtatactcgaatgcccttctaggctgcttcat

SEQ ID NO: 9523 - DNA, 1102 bp, Homo sapiens
ccagcctgggggacagagcgagactctgtcaaaaaaaaaaaaaaagaaacaacaccagaaccactagacctgtgatagcacctgacgtttttgaataccatggtgcattctcacaaactgcttatcaaatgctcatcttttgtgggaaattagctgcagtttggatttgctaggtccttggtccatatgtcagaaagctttgccctaaacgttaattaaaattctggctgtcttacagtgttgccataagtattttctggtatggctcaactaacatatactttcagatacctcattgcctgtgactgtttgctaggcacttggtgaacatacatttactgagcatcttttgtgtaccaggtgctgttttagacatgaggatacagcagtgaactgaatgttttagcatctttttgttgaggaaatatattatctaatcctcctatatctcataagtaataatctggtctgtgcttaaactttagagtcggaaatgtattggtgtctttgagggtcatacctccaaagttaactgcctcctggttactcagacctccgggaagaatgctgccctttacaccgggtccagtgaccataccatccgctgctataatgttaaggtaggtgggtccagagaaatccaaagtggttcatattgagtcgcctttgtatttactgtgtggagtggagacactgtggcagacgcttcattctacccaccatctcctttttgcttctaaacaatgtttagcacattgttgtagccctaggtagatatgagacttacacataaaccatattttctgtctctctccaccagtattttttcacttcctactattaataatataccttccttggtctttgccataaatgttatgcatatcatatgtcaaaactaatcctagatagaataaagagaaaaatgtaggccgggctcagtggctcacgcctctaatcccagcactttgggaggcagaggcgggtggattcacctgaggttgggagtttgagaccagcctgaccaacatggagaaaccctgtctctactaaaaatacaaaattagccaggcatggtggtgcatgcctgtaattgcagcta

SEQ ID NO: 9524 - DNA, 1149 bp, Homo sapiens
tcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaaggtaagaatattgtattggtccagtcagaacaactttcaccaactttatttttttaaatagaatttgaaattatgaatcagaatttctttaaaaaccaaactttatgtgaatgcagtagagattgtggatatggaaaaattaaagctcagcagtagagattttctgctttctcttttgactgtgttataaatattcactctgcttttatttcccttcattaagaaatttcagatggaaaatctaatctcttatatcattgctactttgcccattgtttagaaaaatcctttgagtcagaaatttttacttttactacctgccctgttcacacagatgctgagaacacttttgctattattttgtagtgtggcagaaactcagactgtgatctcctccataaaagg

SEQ ID NO: 9525 - DNA, 1100 bp, Homo sapiens
ttctctaataaaaacaatttttaagtcaactaacagactaaatatggattggaaagagagtgcaagcagtctaggtctagagtccaatctaagcaaaagtcctgtgtgaagacagtggtagataaaggaagaatgggaaacgagtcctagaacaggtggtttgcatgggacagatttcacctggaaaggtggtggtagaaggcggtgattagatgagacagaatgatgtgatggtacactggagcttatgagatacctccatcttagcagttctcacttttggttcctagctttgatatcattgtgcttgactaaatgttttatgaatttccaatgacctactgaggagaacataaagtcttatcctaaataatgggtatagtttagtcttctgagctgtgtgatgagagggaaatctctcgtattaacctgaaccttatgatttcttttggcagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcaggtaacagcatgtggaggatttaataaaaatggatcatctccgaaatcttgttttgtgctgccaaacccatgtctggagtcaccccaaaagcaatggcaggggagtttccacaagggaagtgccccagactgtgcctaatgggggacagttaggattccaaagaaagaagcactaaatgccagggtgatgagtccaaagcatttattaggagagcttacttacagagtaggctgcagcagtccccacaagggtgttctccctaggtatatccacagccagggggcgggatgtggagtttatatgagggtttaaggaatttggctcagggccagggccaatttctttcagtgttttgggcaacaacctagatacttttatcagtgcctgggaatcttcaaggccccaggtagggttcaagcctgctggagaaaacctgcggctggctgggtcacagagcagtcaagacactctgatttttggtcaggacata

SEQ ID NO: 9526 - DNA, 1139 bp, Homo sapiens
cattccaggcagagctccagctgttccgatttagttaccgacttgggattggctgcgccacctactcttgtttccaccccttaactttcactggaagaaagctctagactaaagattaaatgtaagcgctgtcaccaggccttctgagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcggtaagtaattgattttttaaaaaaagcctatctataacagaacacagcagagaatatattttatatctttgtactggtcagcccatggcatttaaacttaggtataaagtttagcttgaggttgttgtcttactaatcaaagggcaatggaatgttttcttgaactactgtaatatcttcttaaaaaagcaaacttagtattgttcctacataagctgtagctacatatctgaaatttttgccatgttggtaactatgttgagaatggctttattggtatccaaatctttttttttttttttaagatggagtctcactctgtcacccacccagactggagtgcagtggtgtgatcttggctcactgtaacctctgccttctgggttcaagcaattctcctgcctcagcctcctgagtag

SEQ ID NO: 9527 - DNA, 2076 bp, Homo sapiens
taccatgcctcatttttctatttttggtagattgctcaggctggtctgaaactcctaggctcaagcgatccacctaccttggcctcccaaagtgttgagattgcaagtgtgagcctctgcacctggccaaaactatgtaattcattttgcatttacagcagttatattttgtaggaaatgaaaaaccacatgcaataaaaaccaaaatgaaaaaaaaaatagttaggcttatatttatttactcatgccaaaataccccttatgtattctttcatgttttttagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaaaaaaataaaaaataattttttttttttaaagtacgctttgttggctgggcacggcgactcacgcctgtaatcccagcacattgggaggccaaggcaggcagatcacgaggttaggagttcgagaccagcctggccaacatggtgaaaccctgtctctactgaaaatacaaaaattagctgggcgtggtggtgggtacctgtaatcccagctacttgggaggctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtagcaaattatctactattgcaggtgccttattggtagagggctctgaagagccaaaactgtatatgcaacacttgtaagataaaagggactttaataatcaagattttcttgaagatttgttagaaataatgtcttatttctggtaacctttccctttttgtatttataactctactaaccaaattacctatcaataaaccattactataatattttaaaacaacctatgtttatcaagcttactctctgagtgacagaatatactaaataaagaattttttaatgaactttggctggaagcaaggttaatcctttaaaggaggaggacaggagaacttaaacctataaatagattaggaagacatgtttcatgcttatgttcagattgtatgagtagtgaaatgccttcatgtgacataaacattttgtgatactagaactatgcttattaagagaatctgaggttgggcgcggtg

SEQ ID NO: 9528 - DNA, 1152 bp, Homo sapiens
aaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagc

SEQ ID NO: 9529 - DNA, 1068 bp, Homo sapiens
agccccttgttttgtgagtgaagttttagtggaatgcagccatattaatttgtgtacgagctgcctatggctgcttttgtgcaactactgaacagcagagttgcatagttgggacacagactttatggcctgcaaagcctaaaatatttactgtctggttctggtctagggtaatgatctaggaatagagattggaatagggactataaggtacaatgactaaaaaatggagattatgtaggagggagaggaagaggcttagtggccatttgatactggttgtcaatatgcagaggatttctgtattgaaagctcagctctccagagaagatgaacagagaggcttgagagacagacgatactaagacggtatctgataggccggtttccttacatgcttcaagaataagatgccctatgggagttggttagctacagtttggtcccaagttgagtgacgtttcccatgctatggcagcctactgtccctcagctgacctccatctgttccctcttttgttgtccacatggttgcttcccctggctgtattatcctgcccaagtcccaggtctaggggcaacttggctttactcaccatatcccggggcccattcttctgcctctctccactggctgatccctgtcccaagccaaattctctgtggcatcctggcccccagcgcaaggtgatatctccccctgctcttcacaggacgtgctctccttggccgtggggccacgggaccctgacgagggagtctccccagagcatctggaacagctcctaggccagctgggccagacgctgcggtgccgccaggtgagctgtggcatctgccaccggggggcttttttctgtgtccttgtgtgagacctgataaccagagccacactggctcagggccagttctcgcagcagtaagcatggtgatacctatggtctctctttcccccccaccccaaccgcagttcctgtgcccacctgctgagcagcatctggcaaagtgctctgtggagttagcttccctcctcggtatggttgctttccatcaaatccctctcttgcc

SEQ ID NO: 9530 - DNA, 1156 bp, Homo sapiens
ttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttg

SEQ ID NO: 9531 - DNA, 1135 bp, Homo sapiens
ttaaaatattattagctctaatgatattaagctctaagttacaaactataagcagttgtaaattaggtactatgtcttttcagcagtatattgttctcaggatagttgtctacctagttcaagtgccattgacatcatgcttgccctataatctaacaatctcagttattataaataatatctgtgttttaacggtgtctttgtaatgcctagctatttcactgggcatctgtaatagaaagatacgtggttttaaaaatacgcatcaaacatttctaggtctttttccccttcttcccaacaaaatagcctaattagtgtatagtattagtagtgcttcctgatgctggaatgttatttgtgttgattagttaaccctaaatactgctactattttttgttgttgttgttttaggttaaatggaaaccacccttgggaactggatgcctgtgtagctgttctaccatatcagtgtattgcaatgagtgggggaggagagcagctggatatcctgagtgttggaatcctagtgaaagaaagatggaaagtggtgagtgtacatctcagagagtgtgtgtgtgtgtgtgtgtgtgtgtgtgtgtgtgtatacatatcggggggtaatttttggtatcctgataaaaatagcatttcattaggaaatattacatacattacttatatgcctaaagcagttatttacagttatttttctatgattaagctctgtttataccctaattcttactcttgcttcgtatagtactaaatttttgaacagatgaaaaaaatacagtgtttgaaagtacaatgagctggccgggcgcagtggctctcgcctataatcccagcactttgggaggccgaggcgggcggatcacgaggtcaggagatcaagaccatcttggctaacacgatgaaaccccatctctactaaaaaaaaaaaaagcaaaaaaaattagctgggcgtggtgcaggcgcctgtagtcccagctactcaggaggttgaggcaggagaatggcgtgaacccgggaaaaaaaaaggaagtacaatgagctgctctctctttttttttttttattaaggaaaattgtaagtatacataaaaaatagacttatataatgaacctcca

SEQ ID NO: 9532 - DNA, 1170 bp, Homo sapiens
cccattgtatatgaaaccagtcattgtctttacagccaaaagaaatattaatcatacaaattataggctaaaatgagtttgtttatctcttgaaactagtacatcctgatgtgcaagtcaagatgacaggtgcttacatccttcttccaagttctgggttatgaaaaactggaggtagaaaatctgttccaaatctcctgaggctgaaacaatttcagctggccctttggctgatgggtgtgaacagttctagggaatctgtactgtggttgtccagagttagctgtgacaggcttggtcagttctaggttcacttaatcagactaacctctgagaatgtagtgtgtgaagtcaggtttagcttgatatctgcctcttctagagcattcatgttttactggttgtatttaaaataaggcagaataaataattctagctctactcagagcttctaattattgtgagaaattagaatccataatttttataaatcaacattgtctataaccctgagaaccttaaaattatctcaaaatagataaatgaaatatttctttctttcttgaaacgataggtatatcctgatcagcaaacccacaatatggacagaaagattaagaatgcagttccttgaaggttttcgatcttttttgaagattcttacctgtatgcaggtatgatcatttttctgtacatcagtaaaagaaatttatttttaaaaattgaaccgcagtctttttaaagcagattttggttttaatacaagaaagaatttatctagcaaagtagaaacaagatttaaacattgactcactcatcctgttttgatagatccttttatataccttagtttactattgctacttttttttttttttcgaagacagagtctcgctctgttgccaggctggagtgcaatggtgcaatctcggctcactgcaacctccgcctcccaggttcaagcgattctcctgcctcagtctcccaagtagctgggattacaggcatgcaccaccacacccagctaatttttgtatttttagtagaggtggggtttcaccatgttggccaggatggtctcaatctcttgacctcccaaggtgctgggattacaggtgtgagctgccatgcccggcctactgttgctacttctgttaatgtttgctgaat

SEQ ID NO: 9533 - DNA, 1195 bp, Homo sapiens
tttatcagagttttaaaaagtgatggcactataccacttaaaatcaaattctgggctgggcatagtggctcacgcttataatcctggcactttgggaggtcaaaacaggcggattgcttgagctcaggagtttgcaaccagcctggagaaaatggcgaagcatctctacaaaaaatacaaaaattagctggggtgtggtgacacgtgcctgcagtctcagatacttaggaggctgaggtgggaggattgcttgagcctggaagggagtggttgcagtgagtcgaggttgcgtcactgcactccagcctgggtgacagagtgagaccctgtttcaaaaaaaaaaaaaaaaaaaaaatcaaattctatattacttttatggtgttactttcccacaggttggaaactacacagatgttatgtattaattttgtcttttttttttttttttttacttttcctttatttgttgtagtatccaaatatatatgttttttttctaacagggagaaaaatgaaagatactattgtgtccttttcaatgatgaacaccattcatatgaccacgtcatatacagcctacaaagagctcttgactgtgagctcgcagaggcccagttgcataccactgccattgacaaagaggtttgtggtctccttttgaattgcgtttctgttttctgtcagcttcctggcagccagatgttgactgagcccttgctcagtattgtgctaggtctgaccatcctctccatttattccttacatcctaggtaaattggttagaacttcagttttgtgtgtatatcataattttaaataactatttataactttcatcttttattttaaataattagaaagttactgaatttatttggcaaagcgtaggtaagaatgtcatctcaactttagtctggtcctataattatttattgaatgaatgaataagtgtatgaattatgaaaagttggtaatttctgaggtcttaacatgatttatttaaattatttttagagtaatattaattctatggctcagtttatttaacatccatccagagcaaaatgggttcttcaagtaatataagtatataaaaggaatattaacctcatccctgcccttgggtgcagtataatctagagtaagaaatagcatgacattcgtcatttaattttttcatttttaatgtactttt

SEQ ID NO: 9534 - DNA, 1208 bp, Homo sapiens
ttggcggtccaaggaagccaagtcgtcagtccccacagactcacctcttagagatttctcaactacaaggacttaggcaaggtttcccttttgactggaaggcttgtagaaacgtgacaacccgccttccctaacactcatgtcacagcggtagcggaccgtattctgggacaaatggaactcacgacattccaaagaaaggtcagccgcaagcgaacttagcactggctacaccctcctcaattctggttggcgagatgcgctcttcccggaagtgacgcacaagtgccggcggaaggggaagtccaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcgggtacgtgcaggacccctttgccgcgttgctggttccgggcgcggcgcgccgcgcaccgctcattcaccgaggctactacgtccgcgcacgcgccgtgaggcactgcgtgcgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgc

SEQ ID NO: 9535 - DNA, 1987 bp, Homo sapiens
ttttgaaaaatccttcctttttcattttgaaacattcttgtttacgttggcagactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggtactcagtaaatacgtgtcttcaactgactcacaagctctcaggtgcttactgggtgggacttgactgttgttgctaattaaatccccattccaccagtgattattgtgactcagcagtccttccctattagtgatcataaaatttcagggaaatcgaagtttctcatcaggaaatgttttggaattactagtataaagttaggaaagtggggaaattaggttactgccgagacctttaagccttctaaacagctttatattttattgtgcatactttaatcagactcccttcactcgctttaagtttttaaaagtattccccagccggatgtgatggctcatgcctgtaatcccagcactttgggaagccaaagtgggcagattgcttgatcctaggagttcagtagcagcctaggcaacatggagaaaccctgtctctacaaaaacaaaaaaacaaaaaaccggaaattagtcaggcacggtggtacacacctgtagtcccagccaccagggaggctaaggtgggaggagacctgatcccagggatgtttgaggctgcagtgagctgtgatgctacagcactccagcctgggcaacagagtgaaaccctgtttcaagaaaaagaaaagtattctccaagatcccaagaccattgacaccaggccacattgtataccagggatttatgtgaatgcctagggatgaccgtagtgacagataaagctaggtgctgagatctggttttgccctctttatgattgtcccatcggtactagaaagtgaagtcattgctccaattttggaagaggagagaataactggctgaggggtgagaaagacagaaatagctgcagctctcttttttttttttttcaacaaaggctctcactctgttccccaggctggagtgcagtgacatgatcacagatcactgcagctttcagttttaaaacagcttttattacattttctttgtggaagctgtatttctaccttagtactcactttctgcttggtctgaaagatacctctagtagtggcaacattgtgttaagtagagttcattgggtctcttgtaaccctacccctacataatggaccactggtgcaggcttacataaacacacatactgtggccacttcagctgaagacaagggacaaactaagatagttctgaaaggtaaaaaaacaaacaaacaaacaaaaaacaaaaacaaaattattagataccaagttatgcttgaattgctttgctctttagaatgtgtgtttttccctggtatcagaagaagttaaggctgatgacacccctaatttaaattactaaggatttctgataggttttctgtctttctgtgatatcgtaaagtatttatttggtctttgaccctgtttcctggcatactgctcctaaaatccttagagtctccagagtgatggctttttgtatctaatgagttgactgctggctggcagcccctaggggctggtcactggaaagacaaatgcatgattagagttgggactttcagtcctcccccaaactcttgggagaagggctgaaggttaagttgatcaccagtgaccagtggta

SEQ ID NO: 9536 - DNA, 1907 bp, Homo sapiens
agagttccaccagcctgggtatagtatttgttataatctagtcgtaacagtagttgagccaaatctgagttgatctgatgattccgaacactggagagaatcttgaacaggagtgaagactggcggctaaagccctgcagagagaaggactcagctgtcattccacttcagctcaccaactctccatatggaggatgggggcggagggaggagtttcttggaaaagccttgttcaaaattctacagaaccacctggccttcccacattcctatttctattagttcctaaaatgacttgtaccaaatccatacatgcatgacttcctatgaaagtactctttcatcagtaggaatttagtagctggtttccagttaatgtattttgtcaagtactggggttggggagaacccgttttgattacaagcagataattatctcagtgagatgggggttagttcaaggaagtaaggaggggggaggatgtgaggaagttagaacaacccaatgcttatttgatgggctgaataaactattcaggactgaactatttttgagcactgtgaggtggcacagtattacctgcttcaaaatcaactgataccaacatttttatctttgtatcttatctctgtacgtgtgtgtattgaggaaatgctttactgactcagaggaaagatcatgaattctccattggcaaaaccacctctgtcctttcggcaaggctgcatacttccaggcagacgcaccttcacgagaatgctcagctgggcggctccacgctcatccagtgggcctaggttctgactgaccagcgaacaaaaactgtgacagagatctaggatttcattcaggcagtgaaacacctacccgggaaacagagttggcattaggaaaggaaggaaggtacatccatgaagttaaagtgttaggagaacagtctgattaatagctgatctaattaatagctgacctcccaaatctgacaggatagacactgccacgtgcaaggcctgccagcccctcagacgcacaaaatgcgtaaaacaaatgcatcctttcctggctaagcgagtattactctcttagccctgcaccaaacctccaatctagccacatttaactcttcatttcttagacccgcagagtgtcttcctgcctctgagctgtgagtgttgttccctttgcccgggatgctcttgtttttaataccagttcaagtcccactctctcagtgaagcactcccttccccactatagcctttagtgaaccctcgtttcttgcttctttattatctgtactgttgtccacttggcaattgttcaggcctctgtgttgttactgatttttgtatgtatatatatatatatgtcttgtttttccaactagattgtgagctccttaagggcagagccatgaattatacctctttgtatccccagtgccttgcatacagtaagcactcaataaatatttaatgatgatgacctgctctgttattctgcttttccctatggatacatctatgccacataaggacagcatctacccatcacagtagttcttggttgttttcagccagccctctggagtggcatctattaatatatatcttactcttcctggtacagcagaaatagccctaaacaccagaacatttttaaaaagtctgtaacagctgtgctgtagcacactgaggaataacaaccagctcatgtcagaggaggcataaccgttccattagaaactaccagagatcatttcagtcttcctgttctttatcctggaattggaactagcttgtgagctttaaaaaaaattagtacctgggtcccactattacagggattctaatttaagtgctctgtcacctagatttttttaaagagtcccgatgattccaatgtg

SEQ ID NO: 9537 - DNA, 1226 bp, Homo sapiens
gctctgtttcctgacagttaaaaaagacctcatgctctctctctgagctgagatcacagctcacctgtgggtactccccaactcttagagctaaagggagaacgaaaggaccaactgccatgaagggacagtgaccataagcttgatggaatgaccttccgtaagataaacatgggaagcacaagtgagaacacctggaaatgttacacgttctagtcaaagacccaatattattattattattattgtcacaatagctggaagcagttccttcccttcctctggcatcactgatccctgcatggcttctcattctctaaagcaggggtcaacaaggtttttttctgtaaagggtcaaagagtaaatatttcaggctttgtgggccatttgatccatcacaactactcgcctttgctgtgagggcatgaaagcaaccatagacaatgagtaaacaaatgggcatggctgtgtttcagtaaaactgtacaaaaacagacagcaggccatagtttgccagctcctgctccagagacagcagtagaaagggtgatctttagttgataatagcagggaataagttgtcagagcttcccagtgtgtgtagaatatgtagtgatgaaaaccagatgcagtgactataacctgatgccagaacactgcattctttttcagtttggagggcgttgttcagtgaatatttctttttacttacactgatatgaatattgattaccagtgatggctgggccatattaagataacttcaacccctatggtttgtgtaagatgggtaattgggcctgcaatcttcagtatttaaaaatctaacaacttgatctcaattttttcttaaggacctttttcttggagaataatactttttttttttttttttttttttttgagacggaatttcgctcttgttgcccgggctggaatgcaatggcacaatctcagctcactgcagcgtctgcttcccaggttcaagcaattctcctgtctcagcctcctgagtagctgggattacaggcacatgccaccacacctggctaatttttgtatttttagtagaatcgaggtttcatcatgttggtcaggctggtctcaaactcctgacttcaggtgatccgcccgcctcggcctcccaaagtgctgggattacaggtgtgagccaccatgcccggcctaagaaatacttttaagtatattttcattagctagaatt

SEQ ID NO: 9538 - DNA, 1423 bp, Homo sapiens
tgctcctggctatactagagttctttaattcttaaatttgatttagaaattttatatgaatttaaaaatttgatttagaaatttgattttagaaattttatatgaatccaaggattcgatataaaagatatatgatcatgtacaaattacaatttgtctctttctgttcttccttaggacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagc

SEQ ID NO: 9539 - DNA, 1446 bp, Homo sapiens
tgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggagggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgtagtgctg

SEQ ID NO: 9540 - DNA, 1212 bp, Homo sapiens
cactccaacactccttcgggggctagctccttctctcctccattctcgcttctgggcctcacctcagcccaggttctcttcgcccactcagtcctgacttcacgcttccacctccagctcaggcgccccctgagcccggctacccctacgcaggacgagctcagggccggctcccagcctcactgcgccccatttcccgccccgcccgacccccaggtttcggctcaccccgggacccggccctagcccctgcccccagcccaggaccgggcccagccacgctcgcccagacactcgccgcctcggccccgccccgcgctccggccactcggcggtaacgagttggtcccgcccgcccgacgaaggcgacgcgcagccaatcagcggctgccacacagcggcccaagccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgagtccattctgccgaggcgggggaagaaaggcggggctgggccgggggcgagagcgcggggaactgttgggcctacgcagcgccggggcccttcattcctgtgggcccctgctgcggcgggcacatttctcattcccgggagctggaggcgcctcgccgagagcgggggagtcggtgctgatcggcccaaggaaaacccgaaggctgcgctcacgcagggcctcatccttatctcggtgctcttgtggcacttcctatttgcagagggttttgccaccccttcccccagtccaatatgtagctatatcttttctgcgtgagtcagtattaatgctcctccagtctacagactaggcatcccaaagccttgtagtggaagcggacgtttcaccaaatgcagaagtcctggatccctagggtatttcctttcatcttacctcacgccgcacagccattggtttctagccaaggtcactgagtggctgcag

SEQ ID NO: 9541 - DNA, 1144 bp, Homo sapiens
ctccatgttggttgggctggtcttgaactcctaacctcaggtgatcagcctgccttggcctcccaaagtgctgggattacaggcgtgagccaccgtgctaggctaattgggtttatttaactaaaatctctttaaactctcatgggcagtatatgtggctgctaatatgcttttacaaactcagaagtcttcctgtttgggtggggcagatcagggttctttaaaaagttacacttttaagctgatctttctgttttcagggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaa

SEQ ID NO: 9542 - DNA, 1143 bp, Homo sapiens
ttaacagttcttccctccccggtccccagacaaaaataaaaaccattattaagcctttataccgttcttcaaatttatcaccaattcctgcagatctaggcgccacaactttactcttgttagcagaaggcctcctggcaacacctgctgccaagactccaggggaaaggagtattagtgggagtttttattttcaatcaagggtttatcaagatttatttacagggcacttctgggaatgacccttcctgggagtttatggtgttggttgagaatgaggactaatatatttaaatatttttgcagggagaaagaactggcaaaagtcactatcaagaaggaagatctggagctaatagtgagtggtagtgcctaactagtgtatgcggaggggaggctattctgcttaatttgggttgtttcctgaaacaagcggagtcagtatatttggtggcacattaatgcctgggaacctatgtaacatgatttttttctgcagatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctgggtgctgtggctcacacctctaatcccagcactttgggaggtcgaggcaggtagatcacgaggtc

SEQ ID NO: 9543 - DNA, 1143 bp, Homo sapiens; identical to SEQ ID NO: 9542

SEQ ID NO: 9544 - DNA, 1299 bp, Homo sapiens
tctcaaagatgaacatgattttagtcctctaaagacctgggatgatggctgggcacggtggctcacgactgtaatcccagcactttgggaggctgaggtaggtggatcaggaggtcaggagttcaagaccagcctagccaagatggtgaaaccccatctctactaaaaatacaaagaaattaatcaggtgtggtggcagactcttgtaatcccagctactcaggaggctgaggcagagaattgcttgaacccaggaggcggaggttgcagtgagccaagatcacaccactgcactgcagcctaggcgacaagtgagactccgtctcaaaaaaaaaaaaaaaaaaaaagacctgggatgactcagcgttttttgctctttgaaaataatagagccaaagattgtttggtttttgtctgatttggatgggactaggtctaggggaacaaagcactccactctaaggactttgggcaattaacaggatctctgtgatgcaggaaggaccgagtgacagttcaagaacgtgaagccgaagcattgaaacagaaggagctggagcaggaagcaaaacgcatggctgaggaaaggcgcaagtacacactcaaggtactggggagtggttgcaaggaatgagtacaagaaatagtgtaatcaggtttgtctgaggagagtaaggaagtccaagctgaattgttctccctatccagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgtgagtaaaaagatgagcctagagttaatgctgctaatggaacaggtttctagcaggatagctctgagactcattacctactgtgagttccattctagccaccttcagagttcttgttgctttgtgagtttcctataattggaatatgagtttcacttgctacagtgaaatcagggaagagaaaaacactttgtcgatgtgtgtccataatagagtgccagccagtgctccctttagtttcctagtagacacaaaaattagtaactgttagtagttatctcttcttgtgtacaacccaacccacaattgagtgacttgaaactataatttattacttttcacaactttggaggttggctgaacagttcctctactgatttcacctgggcttacttatgtagttgcatccagctggaaggttgactgggct

SEQ ID NO: 9545 - DNA, 1317 bp, Homo sapiens
ttacttccaaattttgtgttttgaaatgtatgtttaatctaagtttgcatttaatttttcctgtcaaaccttagtttagaaccccaaatcctcttcctctaaactttcttagtgataccagcaattaatccctgtcagtttcactggtacaagaacactgcatttatgaaacaactgttcaaataaatataatagtaaaaagtaatactttacttgaaatagtgagtttttaaagaaatgcaggattttaagtggttgtgttaacaggcacactaagttgatggtgtcataaaagacattttccattcccattttggactgaaatgagtagctggtgcattcagttctgtgcagttttgctatctgccagctccctgatggcctggagcactgggacctcaggacaaatgtttgcaggaggcttttataggtagggctgtcaagcagcatcaggagcaaaaacagagaaataggctgctgtagtttatatatccccctgggattctacttcagtgtaaaattttaattttaaattttagtaaactgaaaaggataagagcattctgcttccagaacactttatcaggacaaattcattagtaactctatgatactgggcactggccaggtttcagtcaggaccctttcttctcctatcctgcataccaaccctgcacttaggaccagctttctacacttaggaccagcctgctacagaaagggaacaagcacaggtttcctcaatcttctcacattttaaaacgcttggaaggacttgactcactccgttgcagtttcccccttctggaagaattttgtttttgagaaaatgaatggaaaatcttaagtataacaatggcatatttatgaattatgcaagtgtttgaacatcagtttattatgggaagatgtgttttaaatagatacagtattctaaatggtgatgaggttttcaagctagttcacagaaaccacttagctcagggtgcccctggaaagagaagttgtgtattctaggatcctttggggaccctgaaccacaaagtcctctgggcccaagaccctctatagattaaactcttgtatcacatggagtcctgtgaatgaaatagatggaaactcctgagcacactcctttttctactcactgatttactgtgtccttggctctacccactatccatgcctagctgtcacccagtggataagagataagagggaacattcagaccacaagctgatacagaattggaggctgagttggacttatttacttacaagttccttttccggatgagcctttaactgaaaagatga

SEQ ID NO: 9546 - DNA, 3302 bp, Homo sapiens
aacatggtaaaaccccgtctctactaaaaatacagaaattagccaggcatggtgacaggtgcctgtagtgccagctacttgggaggctgaggtaggagaatcgcttgatcctgggagacagaggttgcagtgagccaagatcgcaccactgcactccagcctaggcaacggagtgagagtcggtctcaaaaaaaaaaaaaagactacatttatataaaaatattaactcctcaatatttgtgcgttcctaaagttttactagttatgtctatctggctctatttctgtttgtctgtcatctatgtctattttctaaagatttgttaaaattaatcttgcaaaatagttccacatacttttcactctttagccaagcaactaagaaatagaacactatttgtactaggtgtaaaataacaagcaggaaactaccttaaggctatgaaaaactgagacattaattggatttctgcagtgatttaaaaaataatatgttgatacaaaattattttacttacagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgtttcactgttttgctgattctaatacatacacaaacatcacacccatgatgtaaatacattttaacactaaaatctgagtaagtttagcactcattttaagttaagctaaactaaaaaaccaaatttttttttttgaaacggagtctcactctgttgcccaggctggagtgcagtggcgcatctcagctcactgcaacttctgtctcccggattcaagcaattctcctgcctcagcctcccaagtagctgggattacaggcacgtgccaccacacctggctaatttttgtatttttggtagagacagggtttcaccatgttggccaggctggtctcaaactcctgacctcaggtgatcca

SEQ ID NO: 9547 - DNA, 1994 bp, Homo sapiens
tcttcaacgaaattcttttcaaaatcttaaatttaactgcatctgtgtagtatctctatttggcaaataaaatatgtcataaaataaaaactggtatgttttctctgcaaggtaagaatgtatgttatgaggatcatatctttgaaattttatgcctttttaaaaattgtcttttttccacgcagaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagca

SEQ ID NO: 9548 - DNA, 1566 bp, Homo sapiens
ctcggatgtcccttacagaactagtgtttctgggaccaaaggtttttgtgtgtttgtttatgagggttgctgtaccagataagatgcccatagcacactaaggttcatgaattaactctctttcatctttagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggt

SEQ ID NO: 9549 - DNA, 1204 bp, Homo sapiens
caatacagatcaggtatttctgatgaaaatttagtatgcaaattaagatgtgctctaagtaaaatatcagactttgaacatttatagaagaaaaaacataaaatgtctcagtttttatactgactgcatgttgataatactttggatagacagtattgggttacataaaatagtaggtttacctcatctcttggccagtgctgttggaaaatagcagtgcctctgggcctggcccagagcagatgttcagcaggtattgttgaagaacttggtatcaggttctttattgtggcatcaacttcatagtcatctggttgttataatgggggcttgcctcagttttcagtcttcttctgttatacctacaaaattggagtgataaagtctatagctctttcccaacctgtgctttaaatagttaggcatacttacaaaactggcattttcttttaactctaactaaaagacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggtatgtagatgactgcagtttctaatttgaggtaaatagttagactgataagaggttaaaaatatcctcgttagttttttttttttaactagtgtttctttttctattcagttagatcatgttctagctaatacattgtaaagtagttactgaataatatgtataactgaccactggctaccttttatatttttacatgttcatcaaagttttgattttgatttgatttatatatggtttatgtcatgtaaatcaaaattacacaattttaaaccacagtttagcacttaattgtatagacatgttatttccctaattttctcatgtttcccatagagtttataagctccttgagaacccaagttcatgatttgttctttaaattcattgtcaatgactttttcttccagtttaccttagctttccacctccacagccataccctaggcattatcaatatttgaagtcgtccctcccccaagtcactactttttacatctcagtctctgaccacaacttcccaaactttccagctt

SEQ ID NO: 9550 - DNA, 1103 bp, Homo sapiens
cggtggctcacgcctgtaatcccagcactttgggaggcggaggcgggtggatcacgaggtcaggatatcgagaccatcctggctaacacggtgaaaccccgtctctactaaacaaaaatacgtggtggtgggcgcctgtagtcccagctattcgggaggctgaggcaggagaatggcttgaacccgggaggcagagcttgcagtgagccgggatcgcaccactgtactccagcctcggcgacaaacaaacaaacaaacaaaaaaaacagcgcgctgcagatggagccagcacccgggcttctcgctcccagccccctcccgaagccccgccccgcctccgggtctggaggaggctgggaagccccgcccctccacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggtaagctgggaaggagggtgggaagcataccgatcctgcctcactctcctctgagcccagccatagtcctggcttcccacttccagcctggcgccggccccgcaccttaagcgccctggctgcccagatcccagctggttcccctcggggtgtgggggcagcaggtagtggctgttgcgaagggcagggatctagtcgtgtgcctcccggaacctagccccgtggctggcacgtggccggtgcccaggacggttgcaaactgtttgaatgaagctttctctctcctttgccagctgcagattcatagtccagcctcttgtcattgacctttccaaaggaaatgctaaggctgtctgaattatcggggcagaccgtgcagagcagagaaaggggggccagaggacacttagaaacagcagaacttgtatttaactcccttgcttgggactgataaacctcccttgcaggattatgatgatcacaagagt

SEQ ID NO: 9551 - DNA, 1732 bp, Homo sapiens
tggcagacgtggcagagtgagcgggtgggtgaggggtgggggcaattgcaaataggctctgtacccctgaatcataagccataaggtcctttcctgggttgttggcctgtaaaattggctttgcagaaccacagtgctatcaataaatacggccaagctgatctagtgcttggtagtttggggcacctggctctttcctcttgaaggttgaatataatgctcgtgctcttttacaggtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgactcatgctgctgtttatgg

SEQ ID NO: 9552 - DNA, 1181 bp, Homo sapiens
gcctcccaaagtgctgggcttatgggcatgaaccactgtgcccagccaaaaagaatccttttgtaaaatacagaaacactgcaaacctttgtaaatcttttttttttttttttttttttttttttaatgagatggggtctccctatgttgcccaggctggtcttgagctcctgggctcaagaaatccttccacctcgggctcccaaagtgctgagattacagggtgtgagctaccgcacccagccatgaaaacttctgtaaatcttaactatcgtgttctgcttaaagtgaggtacacataaagtttcctgtgctttgtttttgtaggaaaaagtacatagtttgtatctttaccttacggagtctatgagatttgagaatttgatttcactttttgtaacttaacccacagaaaaggacattaacttagcagataggaccaaggactgaatgacttctgacaaaaagcgtttggtctatccttcacttgttgagctacaaccatgcattacacttctcagctgagctctcaaagagctctatgccctgtgaaaagcagtggctgagttggatgaacacatagcattattaattttgcactgggaaaacagattatgacaggaccacagaccacaatataaaaacttggcagttctttggtgtgatatattttaattagtatttgcaaataatcagagttacttgtgtacataaacgtgtgtttcacaactatggccagatgcaaccttttggtctgtttcaggaaaagacctattattccactaacaattatgctgccttagaaacataatgggagtgtaattgaagaaagcatgtctcagaaggttttgatatgcagaactggaagctattgtaattcctacatacatttccattagctatgccttatgtaatgtgagtgcagatttttacaacttagagttcccatcagtgtttttttgccacatcaccgggtttcttattttactgttttcttttcaactttgggtgctttatttccattctctaaaactaagtttcttgctcttacgagacttagtgttccttttgaacccaggtgttccacctgacagtgtttgtctttcatagactttccagaatagacatagtcaagatcagacacgtgagcttctctctcattttaatgtgaggaaaatcat

SEQ ID NO: 9553 - DNA, 1222 bp, Homo sapiens
cctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattc

SEQ ID NO: 9554 - DNA, 7573 bp, Homo sapiens
ccacaattaattgtatacatggatttaacaattgtgtaatctattgtatattaatgcagttactttaagcgaagccttacgagtttacttttttcaatggttgaattaaaaatacatcttattgatgaaataaaaccgtaaagcaaagaattgaatatttttttgagtatatgaaagtggctaatatcaataagtattaaagatgttaattaaaatatcagagagttggactctaagattattaaaaattagtttgtgttctgttataattttatagttatcttaactgactttccttgactgaaccaacagctatgttcaatgggcagtttttatttgatagacctatgcatgtgaaaatggtgagttcctgtatatcacttcaacctccaacctcttcagatcttttattggctctcttctacattacagttctttgtggtaatatgttaaccatattataaactttcttgcaattaggatgacaagtctgttcctcatgaagagtaccgttcacatgatggtaaaacaccacaattaccacgtaagtaaaagctattatgagaaacaacataggctttttttggtttgttttattatgtgctaagcaacactttgtttttgtgcctacatcctagtttctcacaatttgggattagtttggagttatgaagatagtttggcgctattgattaggaagactgagaagataagtgttacgtgccattttttttttctctttggtaacttttcctgactaatcagcaatacattctaaaatgtttggtaaatttatacacttgaaggaaaaaaagtcctctgtaatttcaccatctgtgggtaacctcattataacatttttgtgtattttcttctagcctgctatgtatattttttacatagttgggaacaaaaataattttgaattattttttgtttaacattagagtataagcattttttcatgttgaagattcttttcaaatatttttattggtagtataatagtctatcatatagatgttccataactatttcactgttctgtattttaggtgttttaacttttcttttgagtaaccacagagtaacacatgcctttttgttcacaaatctttgtaatgtttttgagtacttccttcagacagatattctgaagtagatttacagttctcatgggttagtattatcaaattgttttccaaaatgactataacagtgtaatatacttattgtattatgtgtctcagtgcctctgtgtctcagtgcctcctttgaaaagtggggagaataatattgtctacgtcatggggttgacatgagtattacatgaattaatatatgtaaagcacttagaatcattttggcataatgtaaacactcaataaatattagctattgtttttactatttcactgcatcttctctggtttttaaagtattcttataagaaatcttaaatatacagacaaaagtaaaattactcatatagttatcatatgccatatttgttgtagatttttttctttaaaataaataaaattttatggtaaaatggagcttccccatctcccttgcccatctttcaacttatgccttatccagaggaaacaacttatggatagagtatttatcatttaggttttaataatttgactacacatttgtacatccataaacatagggaattgttttgttggatttaaaattttgtttgagtgatatcataatgtattatgtaacttgcttttttttttaaattgtttttgagattcatttatgttgatagatgtagctctagtttcttcattttaactgctgataccacattttatacatttttctgttttttaggttattttaatttttagttattgtgtattaagttggaaagtatttgctattttttatcagaattatatgttctctttatatttgctagaaattatgtgtaaaactggccttcctctgttgtttctgggaagtttttaactactgatggtttatattttctgtcttttttttttgagtcaatttttgtaatttctatttttctaaggattttttctgtttttgttcattttcaaatattttggcttaaattatctcttaagtttttgctacatctatgtttctgttttaaaaattctgaatgcaatttttatttttttcttggttaattttgttagaaatttgtcggttttaatagagtattcaaataactgaatttggatgttttgtatttctaatttctgcacttagccttattattttttccttctatttattggggtttagtgtgtttttgtcctaactccttaagttgaatgcttacttcaaattggtagcttttcctttctaatataagcatttatgactataaagttagtacatgggttttgctatggagcatttttatgatgggtcagtttttagagtatttaaaaattaccattatgggccgggcatggtggctaacacctgtaatcccagcactttgggaggcccaggcaggtggatcacttgaggtcaggagttcgagatcagcctggtcaacatggtgaaaccccgtctctactaaaaatacaaaaaaaagtagccaggcatggtggcgcatgcctgtagtcccagttactcaggagactagggcaggagaattgcttgaacctgggaggcagaggttgcagtgagctgagatcgtgcccctgcactccagcctgggtgacagagggagactctgtctcaaaaaaaaaaaaaaaaaattaccattatgatttcttattgagccatgtattatttgaaaatggaagttttcaatttccaaatgtatgagtttttttttttttcctttgtactttttcattttaatgtggtcagagaacatggtttatatgtgagtgtgattctttggaattcatttggacttatggatggcctaccatatggcacatttttcttaagtattctgggtacagttggtgagtgcagtgatctatatgtgttcattaaatcaagtttgctaatcatttaaattgtcttagatccaatactttttctgctgtaacactgtttatcttattatcttatgtgtctggtaaaattgcccaatagaatagtggatttgtctactttttcttgtttttacttaaatatttttaagctagcttagtaggtgcatctagattagaattgatatattttcctagtgaattaaaaattttattgggtgattttttttctctagtagttactttgagtctttggtctcattttaatgtaagtacagcagctttattttgtttagtacttgcctggtacatttttcctatttttttactgtttcaggcatgccccttataaagggtgttattgctgggcttagactttttaaaaaaatcactttgatagtttttttcaccatgaaattgaagagttcaatttcttcacatgtattggttcatttggattaatttccattatattgtgtcttatttttttgtcttacaaatacttattttactcctatcttggattcttctggatattttaatatttctgtgaagcctgaagttaatataattattcttttatgtaatagtagagtgacctttggatacagtcactttcctactgaattatactatcattgctcagcattttagttctgtattattagttctgtactatttttttttctgtcctgcaaattagacaatgttatttaccattttcttgtgtcatcactcctctgcttttatagactctggcactaatttttttcccctgaagcatatatgttagaagctcttttaagtgaggatcttttattagtaaattctctcaattttgggttttaaatgttttcaaagatagtttaacttgtataaagattgataattattttctctaagcactttgaaagtattctacagtcttcatgtttacactgttgctattaagtcagctatttgttgaatcgtcctttctttataagtaatctgtccttcctgtgcagtttgtgcagtttgacagcaaagaccaaagtcttaaaatcagctacatgtcattatgcaagcaacctaaggtctcaaaaatttcctcttctatggacaatagatgtggaaacacttaaggtgccatataaatataaataaatatttatatcaatgagaaaactaggtaatataatatttgccttattcagtgttatactttcatggttattgactttttagtttgatttgaaccatttaaaaagtaattatcaaattttaagtgggtctacaaatttgggcaagatactcattttcagatatgtgtgccatatataaggtgatatgatattattcaaaatcctctaggtattttattattcctctcagtgtacctttaagtggggtataaggtgtactttgtattatatcatgttttatttcataaaacacttctcattaataaatggttttatagtcgggcttcagtgtgctactttctagacaaaaacaagaaccagtgcttttatatgaaaatttgcagaaattttacagatactactacaggtatatagctttttaaaaaattttattgccaattagttaatcatatatggatctttgtaatgattgttctcatttttgttttaggtggtcttggaggcattgggatgggacttggtccgggtggacagcctattagtgccagccagttgaacataggtggagtaatgggaaatttaggtccaggtggtgagtattctaacttcctcttttctttttaaatgatacatatgctagctaataaagcctccattgatgtggtctgtaataatgtttaaaggactctaattaatagttagatatttacggtgtcacttcattctgaaaaaggaatgaaaccttgagcacagctaacatgaaagagataggcagaagtcaggagggtttctttggggccagctatgttgtagctagccttttagcattttggattttgaaatgtcttgaaggcagaaggagaatatatcatctatgaacagtatttatggagtagctgaaatgctaccatatcataggcagctaaaatctgtttatccatttgggaaggtggcttttcaggtagttatttggctgctcacctggaagaactcacagttcatttttagagattggtttttaaactttggtgttaggacccttttatattttaaaatttgttgagaacccgaaaatgctttgtttatgtagttataattaccagtatttactgtattataaatgaaaaattagaaattaaaaaaattacatattaaaaaatgataaactcattacatgttaacatacataaaagttttaagaaaataaactatttttcaatgcaaaaaagaaattggtgaggagagtggcattgttttacctttccacacatctttttaatgtttggcttaatattgctgttatatctgtttctgcactttagttttttgtgatattgtacatcatatagtgtttggaaaattacaccttaaactcaagagaatgagggtaaaacatcaaataatgtcttagtagtatttggtgacttaaatagttttgacctattgaaccctcaagagtccctggaccatactttgtgaattactgttttaattgatggactaataaatgctatcagattcctattttgtcaagatgctgtagtcacactttaaattatgaggctcattatcataatcattctgatccaaacaagttttctcccttacccttagactctcacacctacctaccctctcctaaatacatactatttatattttgaaaatttttactgctcttttaactgcgatgtttagagagtccttacattctggcctgatctctaaatctgctgtaatgctatttctgtgtctatgctggaaaaaaaaaatcattgatagtagtatttctgtgtttattgtggaaaaaaaagtgaatgattacctagttcaagatattctctaactgaatgttgtgggtgttactagtgaattttgctttcttgtctgataaatgttcaaagaaacccttttgaagattcatgattagacagctgctatggcatagcactttaaaccatgcctcctgtaccctaccgcttctctagtgtttcattgtggttataccagtggtatctattttgctataatgcattatatcatcttttagtcataaaaataaaatatacttaaagtacatactgtgtattttatttgaggtatgggaatggatggtccaggttttggaggaatgaatagaattggaggaggtatgtataaagatttgtttttttgtatgtacccatcaccatttttaataaactagaaactgtgttgagaattccatgaaaaaaaagtcatggtttattgttggctcatgttctaaaggctgctagcagaaattgagcctggtacatacttaaaggaaggtgatgtgttaagaagtagctgcacaaggtagggtggatgaagagcttactggtgagatttaacatttacaaaacgtacctttcagctacatgactgacagttggatctcaaaattaatctttattccataggaatagggtttggtggtctggaagcaatgaatagcatgggaggatttggaggagttggccgaatgggaggtaggtaaatgtatgcagtgggaagtgtgtgcatatttagttttccctattattaatatttcccccctataacttaggaatgtgtgctaaaaatgtcttcagaaggcatataggcactaggggataaggacaggcctggggaatggggatgatatgtgtggcatgtgaggtaaattgggtaaatgacagactattttatatttgtgacttacgcgtcttttcataatttagatacattcctgaatgttttcaacatgtattgatatatttgaaaaggttaatttgttgcacaattttttcagagctgtaccgtggtgcgatgactagtagcatggagcgagattttggacgtggtgatattggaataaatcaaggctttggagattcctttggtagacttggtagggctggctgcatacttctccttttctttttgtaggctataatttttgaaatttggtttctctttttttgtgaaaaatcagaaaatcataatgttttatacaacttattacctgaagaaaacactttaaggattttaatatgctagctctctttttcaacatcttacatatttgaactctattttcagaagactttatgcttttcatttattgtaaatcagagcacatagtaccttgggaattttaaagtatgattatttaaaattaattagtatattatctttccatccttgtttaggcagtgcaatgattggagggtttgcaggaagaataggatcttctaacatgggtccagtaggatctggaataagtaggtttaaattttactagaatttattcagtaatatttgagtgcttgcaaagactttgcaagagtagttatcgtagtatagtaatactttgttcttatacgttaatgtgtcttgctataatttgagaaaccttga

SEQ ID NO: 9555 - DNA, 1377 bp, Homo sapiens
gctcatttgcgaacggattttttatccagaaatagaagaagttcaagtaagtattacaaaggaagatacagaataagtaatataacatcttaagtgaagaaatatatataatcttgagaatttaatatgctgtttgtaactaaatagtatatatgactaaacttattttaagcaaatttaaaatactagttttagaatttctttaaatgtttttcatgtagctattatgtagtattactttggataataagttatttaaacatactgtgaacttctaatattttattagaattttttaaagttatccagtattctaatttatggagctttttagaatttaattttctttctgtaatctcccttttgaaaagatgatatagcaagagtagaattctggctgtatttttcttaggagctggagaggaaaactgaaagaggctcttaaaaaaaactgtgaagcttactacctttctatctttcaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctca

SEQ ID NO: 9556 - DNA, 1134 bp, Homo sapiens
ctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaagcctta

SEQ ID NO: 9557 - DNA, 1128 bp, Homo sapiens
tacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctcttgcatgcttctggttcaggactcttgatttgagatatggatttgattgagtatccaaacttgtcctgagtgcaaaactgtttcaccttttaaaaaatacctattttgcacctagccttgagcaccttccacatagcaatgaccatagttactgtcaggaggtcaaggaaaggaactttgcacaacttgtgacatgtatcctgataatcaaggcttagaggaggaagttttagaagataagagaaagttgttctaattgtgctgaaactattagatgatttagagtatacagatatgtaggtattaattctctattcactattatttatctctgcccttctctaggagtttgtatacctgcttaggagacaataaatgagctaaatgttttat

SEQ ID NO: 9558 - DNA, 1375 bp, Homo sapiens
aaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacattgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgt

SEQ ID NO: 9559 - DNA, 1146 bp, Homo sapiens
ctgttgtatagtgcacataaggaaagtattcttattaacataattatatttagtgctagatgactttgccatgtgtagattaccatcctagctggttttaaaccgtgttacaataatgaaatttagacttggggaatagaaaaattagattacagaaccaaagattaataattagaacacatctacgttaggtttccctcagatttcatgactaacgaaagcttagcaactacagaattggggtcattaaccaatattaggttgcattcttcttttatgttgattctatagaaattttagctttcatctgaaagaaagtaatgattatattctgctatacacttgattttgactcctccttcctcctctcttcaacccctggttttatataacagttgaatatcagtggcattttacgtatgtattcaaggttgttttgttttgtaaaaatatgtggtttttctgtcttaacagcattcactttttacgttgctacgtgtgggtttcttttctttttttcttttaatatttctttctttccaacacaggaatactctgaagatagtaactccgagccaaatgtggatttggaaaatcagtactataattccaaagcattaaaagaagatgacccaaaagcggcattaagcagtttccaaaaggtttatattcttttccatttgattctatgtgttaatttttttaatgatatgctagaacaaataagtcccaggtgattttatctcagaaatgtgttttgaatacttaattatcctatcagttagcattaggcagcacaagcaagtgtttcaaaacggttatcctgatgttttttccaatcaagctgtctatggagcagggccattgtcctgaaaaactaggatggttctggcagaagaaccaccaacatgatggtcagtaggtattatcactgcaatcttgtttcttttaggggtaaatcatacagttgtggtttcattattatgaatagcttgatttcttgacttactgatacacttacggattatttttaccataggttggttattcaggggaaaaaatatttcagaaactatataataatcaagaagtggctctttattttgctgatgaaggaactttaagcttgcttatccttatgtaggc

SEQ ID NO: 9560 - DNA, 1099 bp, Homo sapiens
gcagtttgaggaaataaaggctgaagaaagcccaggtgatacatggttaatagaggcagaaatgtaaagaggacaactctttcacaaagcctaaaatcagctttcctaaaattgtgaaagaatggagataacagagttagtcctcttacccaggaaggagctcagtgaccctgggagaactgaaactgggaaagttctcaaacgctagatgttacttcactgtgagaacacaatgctacactacaattagtaatggaaatgtaattaaccacttggcacttgtggcttgcctcagtcattgccacactcccagcctgaaaagtttaaaccaagtaactccagtgatcacaaatggcctgggtaatccagcttgtcaaaagacttgaacacagcattgatgaagatcactctgctgacatgtttgctcactcatttccaaaagccttccccagcttgtttcattttaagtacccttttctgaaaatatcaagggcctagtatatggaagggacaaatattgttcagttctggaaataagaggaagtggaattatttctgcagagatcaggaagaaatgtctttgcctggaaggaagtgggatggttggaatcccacctgaaaagctgcggaagggcatttgccagcttcctggaattctctaataaactttctcttcctagagtggtcaacctgtacttgttttcatggagcttacattctcgtggggaaagagagaaatgacaattaaaaataatttgaatggtagtgataagtgctatggaaaaaaatgagaaggaatagagactacaggtttgggtgggtactctttctgtggagtggttgaagaaggtcactctgacgaagagatctttgagcagaggcctgaaggaggtgaataaatgagaacagcaaatgcataggccctgaggtggatacttggctgtcaggtgtgaggctcagcaggatcagcatggcagagggccaggaaggaaggagaggtagtagatgaagtaaggaaggaagtggggagccacaccatataggccgtgtaggccatcggaaggcttctggctttgagaagagaaagggggcaatggaa

SEQ ID NO: 9561 - DNA, 1685 bp, Homo sapiens
ttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacatatgttcattgtagacttatgtttttatcacatcttattaacacattaaaaatgttatcctactgcatatttgagccaccatatgaaaatattttatactctccacaacatgactttaaaattcctgaggtaactcttgagaatttgttaactctttcactggaattaccagtatatttgttaatgtaataaaggggtctatggtctgtcagcctgatggttactattggaagcacttaaaaaagagtttagggcaaattgaagaactctgtaaggaagaggaaaaagatctttttcaattttccactaaatttgacatattttaagtgatccaaaaactagtttttaaaaatgccaggccatattttcaatagcatgaagtgactttttctgcagtcctgaaaagtcaatagagaatgttgtttctggttacttcggtacattaatttgtcatgttaggcagggtgctggtaccacagccaggtaccctgacatgtggtgctggagcagagaagggccagtgtcttcac

SEQ ID NO: 9562 - DNA, 1195 bp, Homo sapiens
gtaatagtacccaaataacctctgcttcccttgatatctactccacggtatggttttttttgtttttgtttttatttttttattattcctcatttggcattctgggtgagttcaaacatttgataatgccaaacttccagggatcatttaaaggagtttaaaagagccttctctactagagctcctagttcatgagaagtgagataatctatctcaaggtgtctctaagaaccatgacccacattaagaggttaaaggtatgtgtttcatgggaaggtctgagaccttagtcgtatgactaatgttaacctaaatattaaatgtcctggaaggcccagcatcttatgagttaacatattaactgtttacaagatgcctgtggtacaggtgctacagtttgctgccatttatagtatagaaccttaatttcatatgctcagcattttaagacatcttgtatcctttttcttcctcaggccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtaaatacatgtcatactttttgcattataatgctaaaaggatgatctaaccatatttactgtcttagtccattagttttctgctgctataacaaaatacctaagactagataatttgtaaagaacaaaaatttattttctcttagttcttgactgggaaggccatcgtctaggtgccggcatctggtgcgcttttttgctgcatcctcacagggtagaaggtggaagcgaaagaggacagactcgtcctgtcgagccctaaacggcacctaatcctgttcacccgggaggggagccctcatggccttatcacctctttaaaggccccatctcttaatcctgtcacattggcaacacctgaattttggaatatttgacgtgaatctggtggtaacctatgaataagtaagcattttggtgtagggctacagtatgtgaataatttcatgttgacatcaagaacccattttacctttcaaaccatagtacttaccactcagctccag

SEQ ID NO: 9563 - DNA, 1319 bp, Homo sapiens
tacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccacttcttggctaaattattatatcaaatata

SEQ ID NO: 9564 - DNA, 1580 bp, Homo sapiens
tcagccgggcatggtggctcacacctataatcccagcactttgggaggccgaggcaggtggatcacctgaggacgggagttcaagaccagcctgaccaacatggtgaaaccctgtctctactaaaaatacaaaaaattagccgggcatggtggtgcatgcctgtaatcccagctatttgggaggctgaggtaggagaatcgcttgaacccgggaggtggaggttgcagtgaaccgagatcgcgccattgcactccagcttgggcaacaagagcgaaactccgtcttgaaaagaaaataaaaggttcctaattctccatttctaagaaatactaacttttttcttttctctttcttttttttttttaattgttgtgggtgttcaatgtagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgctctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagtttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagcccc

SEQ ID NO: 9565 - DNA, 1225 bp, Homo sapiens
acattaagaagtatcaatttcaaataaattcttgattaatctgactaccacaagggtgaggtatgtttgaatagaagaagggaagcatcagaaatattgagtttctccattactggcatattcagaagcaacaatatattctaattctaaaaagttcttgatccactatctagtaatttatataaactgacatcacagtgtccatgaaacagctctaacttctaagtttaattcagaagtgtgtagaattttagttgcttttttaaaggttttctctaaaatgccagaatttcaaaaatgcctaacattacacatgaattcaaagatattatgaaagtatccttgatttcttacctattgctattaaatttctttgtataaaactacatcttggtccattttatcttctgttccttaatcaaagatgcctgctaatttttattttactttgtcgtttttaaaaagtcacaatttaatcttaaactttttccatttgtgttgcaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttacaaagaagatacagttctgcatctctgtctgagagtaagtgtcagtgaatatttaatagtggaacataatttaagctttatattttaacttctgaaatatcaataagccaaatataatcttagtttaaatattaaacaagggttctccccaccctcccttttataggaaattcaacaacagagagcagcacaaaagcttacgtttgcctttaatcaaatgaaacccaaatccataccatattctccaaggtaaatctttaatttttttctgggatcttttattatatggatagcagtcccttttgaccttcatttttgatgttgaatatttaattatccattttgtagatcaattagaattttattaacaaaactgctagtaatatttataactattttttataaggttccttgaagttttcctgctgtattgccattcagcaggacagtggtttgctgtggaagaatgta

SEQ ID NO: 9566 - DNA, 1390 bp, Homo sapiens
accactgcactccagcctgggcaatagagtgagaccctgactccctccctcaaaaaaaagaagtgataatgaggagttatatgctctttggaactgccttttatacttttctctctcatttttgactgaaatagacttttgtcattgtttattgtgtgtgtgtgtgttttgcgtatggtcctgtgccaccgattaattttttctaaatgatgtgtagagcaataataaaaaactacagttacttagaggagaaatgcaaaaacggactagaccaaataacatggtaaaatttagtgttatatgtgttttctggcatttgtagtgatttgatattgtggggtttagtggtttttgttcctttttggtccttgtgtattcttctgtaggtttggctatgaccttgttttaagtttgttatgaccttgttgccttatatcttgaaggtgtggagaaatatatcacatattatagtgttacagatttagcacaggattgttctgaacacagtaatgactgtaatcccagaactttgggaggctgaggcatgagcccaagagttcaagacccacctgtctctactgaaaaaaaaaaaaaaaaaattagccggctgtcttagcacgcacctgtagtcccacctactggggaggctcacaagggaggatcgcttgagtccaggagtttgaggctgcagtgagctgtcattgcgccactgctctctttcctgggtgaccctgtctttaagaaaataaaaaaaacaaaatgaataaactttttttatgaacaggtgtggcaaaacatgttggagatgccctcaaagaacatgcttccagatcatctcgaaagatttgcactatcggaatagctccatggggagtgattgaaaacagaaatgatcttgttgggagagatgtaagaattatttttaaaatttcttatgtttgaaattatatgtaaacaaaattatagtaagaatagtgccagtttaaaatatttatgattatattatacttttcaaattaagtttaaaaggtattttcctgaggtttacttctgaatttttggaaatgcataaatataaataattcataactataaataattaagttcataaatataaatgctgttacagtgttggcacattttgctttcagtcttttatgtgtaaaattatttcacattttccatataagctagtctttgtaattaaatttttaatgactacatgacatgagaattaattttattctcactaagactagggaataggagttaaatgctagtgttttgtttgaataggttaaagacatgtgaattggttatagatatttatcaacactgttaaaaagaattactggctgggcgcagtggctcacacctgtaatcccagcac

SEQ ID NO: 9567 - DNA, 1193 bp, Homo sapiens
tcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggccatatctcagttttctaatctgtaaaatgagtaggttagaccagctaatcactctggtaccttccaacttgaaaaaagttttttccccattctttggtaaattttagatgtggcctgaacattctcctggaagtcagaggtcaaattatctttccattttcttttattttagtaagaatttcgcaaatgacaagtgataacaaaggcagcaggatttttcatttctctgtaaataatgtataaaatatgtgaacagaactatatctttcatctaaggccagttcaatttattaaaaataaaactaatgccttttaaaattgatcagacctttgatacttgaactaaattttgcattagagactttttaaaaattgttcgcttttgctgaataaattgcaaatagagaagcttcattgacagtcagtccctctctgcttaatgcagttatgggtcctttcgtttatggcaaatgacttacctgacaagagttaattttgcctccattgtatcaagtttgaatattttccaagaaatctgatttatttggcagactctgagagagagaacagattaagtgccgttttaaaactctgtattttcatttataataataaaatatttgccaaaatacagctgttttgtaaaattatctgcaccctcatccaagctttatatttaatagccttaatcacattttatgaagaatgttaaagaaaattttttttttactacatcgaaatgagataattaatttcttttttttttttttggaaatggagtctccctctgtcacccaggctggagtgcagtagcaagatcttggctcactacaacctctgcctcctggttcaagcaattttcctgcctcagcctcccaagtagacgggattacaggtgcgtgccaccacacctggctaatttttgtatttttagtagagacggggtttcaccttgttggtcag

SEQ ID NO: 9568 - DNA, 1141 bp, Homo sapiens
caactgtcttgctgcactaattcataagataccatatggacaatgcacgtacgtatctcttacaggaaatcttataatgttggtgtttataatttgaaacaatacaaaagtaggagtattatttgaaacctatatagtccaatatacattggacctacaggtgtttaaatttaaatttaagtaaaattaaataaaattaaaaattgagtttttcattcttattagccacatttcaagtgctcaatagccacatatgactagtagctactatattggacagcacagatatagtacattattcatcatcacagaaaattatattggactgataaacattttattacgtctcatttgttttacttaaaatcaagactttcaaaattgatatttcagtcacttcttatgactgtggttaatatttgctacttcttatatcaagtgaacattgtacttcatctgcagtgttaactattttaatctgttttttaggattgcatgtcgtggcaaaaacatggaagtgagacttatttttctctctggactgtgcatagcagtagctgttgtttgggctgtgtttcgaaatgaagacaggtatgaatactcaatgtatttgcttttagattaaggatgaattgtttcctatcttgccctgatacttattatgattattatggaatttttttgcttctatgccagaacaccagtcttgtaatgaactacttcttaaataagcagatcttatgttaatgcatttgaactcatatagagaaggaaatatgaattatgattttaacacatacactgaaatagactttaaaaatatacttaatttcacgcctgtaatcccagcactttgggaggccgaggcaggcggatcacctgaggtcgggagtttgagaccagcctgaccaacatggagaaaccccgtctctactaaaaatacaaaaaattagccaggcgtggtagtgcatgcctgtaatcccagctactcgggaggctgaggcaggagaatcgcttgaacccgggaggcggaggttgcagtgagcggaggttgcagtgagccaagatcgcgccattgcactccagcctgggcaacaagagtgaaactctatctcaaaaaaatatgtgtgtgtgtgtgtgt

SEQ ID NO: 9569 - DNA, 1277 bp, Homo sapiens
ttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggtgtgaatatcacttttttttcaatcttggttatttcagtaatttcagtagctcttccagttatagctataaagctcttttactactttttactagttaatctaaatatgttcagctcctctctttataggaggcagatatttatactctatgtgtcttagactgaagttttgataataaggagtaggcttaacagcttgagagtattcttgtgtcatatttatctatataccatctacatctagcatagtacctggtacatactgggtgctcaataaatttgtgtagaatgagtgagcgaacatattccctttacacaatgtttatcaccag

SEQ ID NO: 9570 - DNA, 2051 bp, Homo sapiens
tgtatttaacattccatcctcatcaacatgatgaagcccctttcttccatctttgtagggcacattgtatataaatattttgtacataaagatcatcaaataccataatggggtatttggcttcatctggaaaattgactggagggagatgctgtctcccagccctgcttccctcgtccctgtccaagttgctgcaggcccaggttagaagattaccaacctggaggggcatgcagttcatcttacaataaaagcccattcatttaaaaactcagaaatcatcccagtgcctgtactcctcaaaccaatttccctaagggaagactggcacaccagcccaaagagcaggtgcttctcttccaacagaaacatggcccctgacagggcaccagcattagggaaaccaatgtcctccgaatagctgccatgagaacatttcagatgctcaaactgaaaattcttaaaaccaatattaagcatcagcatgctttaagtgtaagatagccctttggaatttacaaacacatgtgcagctatttccttcttcacagatatgatgtactcagccccctcctaggcactacgaagaagacagaggaagcataaaaattctggactaatataattttatatgtgtttctgagattggggagtagactgagtgccttttttacaaagaagatcccatatttaattcaagtatttatagcatcagcaaaaatgggcagagggcgggaagttgagaacactaggttctgtgctatgttacctgtattcagtagaagtgtttctggagtcaggttttaagtcatgatcctgaagcttccttcccctcttccactaatgatgcaataatagctgttttcattttaacgagcagagaactaagaggaaaggtcctagctctgccttccacttgcagcttccctttacctcctcttattgctttcatctcaaatatccctgctactcaaccaatcctaaagctaaagtactgagatgcacacaaaggaaaggtgtgagagtgcttggaagcatccagctgagcccactggatgaaaatcagacgatagggcctcctgttgtaatatactagccagagaaaagcgccaagaacttcagggatattattcactgctttattgctccctaaccctagatcagattggattttactttgtagttcaggagttaagaagtcaaattgctgaccgaggtggggaaggatgatggaaattaaaggtttacatttgtttaatggcagaactgagatttgctcagcttatctctttcccatctgtctgtaatagcaatgactgaataatcagtagaccaatggaagaggagttgcaagtttaaatttgtaacctgactctgggttctgttctaggaatagtgcatgttttagaggctttgccagttgggatacattgttgacttgggggaggatgaaggagagaactgatgacctagacatagaaaagagtagttaactaactagatgttcttctgatctcttccatggtagacattctgagcacattggcccagttagttggtatggtgaaggggcaccgtactaacagatttggagactgaaacctaatcccatcaccaacacttagcaggtatatgatcatgggcaattcattcaattgcctgccaattatagactatatagggggaagagcactggatttggagtcaagaaacctggacacttggctccacacttccttagctgggtaactttgggcaaaccgcttggtctctcaagcctaaggttcttcagctataaaatgggaataatacttcactaactacctcacagagttgtggtaagaatataatcagataactggataaaaacactatataaactggaaagcgccgtacaaatgtgagagatcagttttattatcaaatcactgttttccactgcctcttgaatcggctttattctaaccaaccattacatctttctcatcttttggagtatgggtaattgaggcttgggtgtgtcatcagggactggagttatttcagctccc

SEQ ID NO: 9571 - DNA, 2137 bp, Homo sapiens
gcatgtaattcttttgttgaagccccttggttctcaacaagtaaatgacagtggtgaatgatgggaagtaggttgttttttttttttttttaattagtggtcatgtgaactggaaatggacatttcaattttgtaaaacttataactggattatgcagaaacttgcttgttataagcaagttaccattgtaaaaactaatagggatttctaacatagtttcttttatttttctcatagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggtcttcttaaaacaaagtcatcagctttgccaggttacatactttatttaaaagtatagtgaggtcgaagttcattccagtgtttcattttaataatgtgggcattattaaatttttgtggaagctaatagtaaaaaataaaagctgttttcaccacctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatttttctggagggaaaagtctcatttctgaggaaggcaaggtggctaatcattattaattttttttaaactttttgggccgggcgcagtggctcacgcctgtaatcccagcacttttgggaagccaaagtgggtggatcacttaaggtcaggagttcaagaccagcctggccaacatggtgaaaccctgtctctactaaaaatcaaaaaagtagccgggtgtggtggtgcacacctgtaatcccagctactcaggaggctgaggcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttc

SEQ ID NO: 9572 - DNA, 1741 bp, Homo sapiens
aaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagt

SEQ ID NO: 9573 - DNA, 1170 bp, Homo sapiens
ttttaaaggcacaggtgtttcttctccaggtcttgcctggtgagtcctttccctttctccttgagaatcctgaggtttcaacatgggaggaggtgaaaccctcctacattgcaggtgggaacatttaataacgtggccacacttcactgcctgactgccgccatcatgggtcgcatgcatgctcctgggaagggcccgtcccggttggctttgccctatcgccacagcatccccacttggctgaagttgacatctgatgacgtgaaggagcagatttactaagtggccaagaagggcctgactccttcacaaattggtgtgatcctgagagactgacatagtgttgcacaagtacgttttgtgacaggcaataaaatcttaagaaatcttaagtctaagggacttgctcctgatctccctgaagatctctaccatttaattaagaaagcagttgctgttcaaaagcatcttgagaggaacagaaaggataagaatgctaaattccatctgattctgatagagagctggattcaccacttggctcgatattacaagaccaagcgagtcctccctcccaattggaaatatgaatcatctacagcctctgccctggtagcataaatttgtctatgtactcaagcaataaaatgattgcttaacaacaacaaaaaaacccaataacgtagccactgtgaaaaacaggttagtagtttctcaaaacattaaacagagttaccatgtgactcagcaattccactgctagatggaattaaaaacatgtccacacaaaagcctaaagttcatatcagcattattcataatagccaaaaagtgcaacaacccaaatgttcatcaactgatgaatggataaacaaagtttggtatgttcaaatagcggagtattactcagccataaaaaaagaatcaagtacagacatatgccacaatgtggacaaaccataaaaacactatgttaaatgaaaaaagtcagacacaaaaagccatgtgttgtctgattctattgatatgcaatgtccagaataggcaaatccatagagataaaaagtaggttaatggttgccagaaggtgagggaagggagaaattgggagtgactcctaatgggtatgaggtttctttatgagatgacagaagtgtctggaattaaaga

SEQ ID NO: 9574 - DNA, 1308 bp, Homo sapiens
gtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaacaacctcagattgaaaaagcaacctaaattactttcgctctctaatcagcatttcaatgtatttatttttaaattttctcaaaaagtaactaaaaaattgtgtcggaccctacttttgagaaatctacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcatttcaatacattgtacatgaaaaaatgaaaagtagaactttgtaatactttaatcaataaaattaattaccaaatgaattgggtcagattctttcattgcgaggagatgacatgtctcttaagtgtacaagttgtatgcctttctttacggtcatactgaaagatgctagaatctttatagattcataatatctcatttaaagtatattaaaatgtttagagaagaagtaaatatgtcataagtgctggcttaggctgtgtctccagggcgcttccacactgtcagaatgaggggctacttggcagagaattggcagggtttctgatcctgagctgcggcctccatgccctttctagaccttccccacaccatgaggagccatcactgttggttttcggcttccataactcaggatttatgcctgttttatagcacttaccctggactggaagccagaaatgctgcccatttcctctgtaggcctgtgagccccagagggcaggtgccacatcctcctcatccctgccttcatcctactgctgatgaggtgggaagagaactga

SEQ ID NO: 9575 - DNA, 1149 bp, Homo sapiens
ccttggtttataccaagtcccctggggcagagagcagagaatctggaggggcaaacggaatccctccagcaatcccacctaaaaaataattcagggattcagagagcttgtgagcaaaaagaaaaatgaaaaacattcaaaatcaagcacagaatcaaggcaagatgactctccgaggaacctaatgtgaaatgattactgggatattaatttttgtgttgaacttcctagcagccatggcagaggggaaacctgtgtatagacacatgtggtatatgtctacagaggtcgactagaaggaacagtgccccagatgcccctggggtccacttcacgttcctgtcccagagcttggcactgatgctacctgcatatcttgaatgaatccaggtgcccatcttactagtcagagaagagatgcagtattctaatctgggaaaatgtttgtttttaggtttcaaggaggattttcagatggacgtttttaaaatcctggcagccatcctacatctgggcaatgtgcagatcaccgcggtgggcaacgagaggtcctcagttagtgtgagatgctcatttgttttacttttcctttgtctaagggtcatagtggaactggctcgcagctgacctgcctttgctttttagcaccagatatagtcggcctcctgggtagactggtttaacaggaggcaggcggcaagggtttccagggcttgccttcaaagagtaaagcctcctccccttgcaacagtagaggaggggaaatggatctcctgtgtgcttttcttttattcaaaaagtatgtatgaagcacctactaagtgccacggactgtcatagcatctggggaaacagcagtgaacaaaacaaagcaagaagcccttcagggagcttatgatcaagggtagggaggagacacaacaagcaaatatgggctctggcagctgacggctggcacagaggaaagtaaagcagagggggcatgcagaggtgctgtgtctttcatgtggggtggtcagagaaagactttctgagaaggtggtgggtggcagcctgcaggggatgaagaagcaggttgtgcctgtggatgggggaagaacagcaagtgcagaaacccgcaggcaggagatgtcatttgaaaaacagcac

SEQ ID NO: 9576 - DNA, 1398 bp, Homo sapiens
ggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatataaagagtttttgtcagtgtcttataagcaaatccactgcacattttaaaacaacaaaacaagttgttttcctgaagactagtgaatgtaaatataatccctccccatgagaatattctaagaagtcttggaaatttaaaagttgacgagttcccctcctatactggacaccctagtaatatatatgataaagaagagaactgccaaacacttaagcaaacagaaacagctgaagaagaggtagtgtcttttcttcaagggaaagtcatgcctaaatatattggaattctctgacagagaaatagacataaccaagggaaatttgatatgcataatctacttagattttcaaaagattgagggtgtcatttgtgtcaaaagttctacttttaatatagtgggacagtagacattttttggcataagacatagatcaaagaagtatgcagatgtgcttttttgggtaaggaaacagagcagttattcagatctgtggtggaattagt

SEQ ID NO: 9577 - DNA, 1154 bp, Homo sapiens
ttgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctccctt

SEQ ID NO: 9578 - DNA, 1191 bp, Homo sapiens
actgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgca

SEQ ID NO: 9579 - DNA, 1150 bp, Homo sapiens
gactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtat

SEQ ID NO: 9580 - DNA, 1150 bp, Homo sapiens; identical to SEQ ID NO: 9579

SEQ ID NO: 9581 - DNA, 1161 bp, Homo sapiens
aatatttctgcaaactattccaaatgaatgcattttatatagggcaacacatactggcacctgattctggtttattcgagttcatatgtagggtttgttgggaagaattatatgattggcttctttttttagaggaaatattttcccttttttcttatccatatactattctgaacagctttgcagatttccttaagttcatagcttgtaagtagttcatggtatatagacatagtcttgacttacaactgaaaaaaaatttatgttacagaagtttattttttctatggaactgtctttaaaaacaaaaatattacaaatcttgaccttgaaatattctgtttcctgttatcacattctggatatctattttgtttgcaaatgaaaattattactgatgattagcaacttgagcctgttaataggaaattgcaaagcctgaatacacacacattgccttagcctatcagtagagtagaggacatatgttaagaaaatgtgtctgcttgttgctgttgttggacaaaattttatgtctgtgtgtatgatttttttttttctattttcttcaaagatgtgaattaaatgaaagtgtgggagccagttaaattattttgtattatgggtgttctggatcctttcactccgtataccattttcttgtaagggcagcatttgtagacttgctaatggactgtagagctgagctatattaattttatacttgactcaggggatcagttctgtgaatgccattgcacgaagaaagcaaatgtttgccttgattttgaatgtatctttttaatgtcttcttaaaacatatttgtttaataatgtagatttgtttttttttttctagtatcatagtaaatattgcttagtacttgcccccaccccactgggtagtttatatactaccctataggtcatgccaaaaatgaataaaagtttaaatgccaaaatgtttatgaaactgctgtctaaatactgattgattgcacaatttaaataaaagctttccttagttaaaaaagacaaacccatgttttcttttattcttcagttttcttttgggggaatagagaatgaaaattttccatttataggaggttggctttcacatcatgggttgggatgactatagaatccactccaagaagt

SEQ ID NO: 9582 - DNA, 2077 bp, Homo sapiens
gcttatagttacaatagaactttaggctataactatttgataattatttaacagtacattttttaccttttcattttgttcttatacggactttttcataataattctgttaccaaagaattttcagtagaaaataaaattttgattataattccccccaaattgaattaactagaagcatttatagatatgaaacttacacaagtagttactaacccaaaacaatagggtttatattgattgttgtagttaaatagattagtaatgttaactaccttattgttaccagagcatttaaaataagttgtaatactttctttaccagcagatcgttccaaagaatttcaggtatagttttttcttcagcaagtaaatcttcaactatacagtattaaagtatttttatattgttgaaactacttgttggagagaaaattttttttttttaccaaaaataaatactttggtctcattgaataagatatttagtaatacagcaaagacttctttttacttgaccaaatcaagcttctttgaagtcttaagtatgaaattgtaattaaaatgtgaagattttcactcatttttcatagtggtattacttcatggtattgtacttcaaaggggctaatatgcaaatggtaactattttcttttccaaagatgtatttgctgtaagtactgatacctgcatgtcatttttatgccaaatattacaagatactgctcatcagtattttcataccaaagaccattaagatgtataggttagcctgtaagtaagtaaagatgagcagatttgaaataaatttatttagaggccgatagagaatctagctttagtagcaaaaaatatcaaagggctaagtttacataattaaaagcaatacaattatattggtatttatcagtgtttttattcaagtactttttatcagcaaattaaaaagaaaaaaaccaaagatatttaaggttacctccgcatataggcaaatatagttgtacattaaactgttgtttcttgtttttatgttaaaccaaacatgtctcttcggaacacagtctgtatacaaataacatgcatgaggactttccatttaatctgtgattcagccacatgatgtttttgccaaatgatgtgatactttccaaagcaccttgagtgtgaaatgtcaacagaaatatcagcaagcttttatgttgcagagtattatggtacctctgaattagcctgtatagttctcttcctgctttaagcattacctggttagctcagacggcttgaggcagtcccttaataatagggatgcttttcatctctaaggatgtaagaggcaaacaaatcatgtcattctttaagtgggctatgctttgatagatgtgctctttaaaggtgtgagattggaatttagagttgttaaattgaaatgtttgcattgcaccaaaggagctcagttttcaaactttaatggaaccttgggtaaagggaaaaaatttttaatgaaatctggggttttatattttgattagcctaaaagtaaaaatacagctttatccattaagtgacttttaaaaatcagttttgccataccaaagaaattagattcttagtgtcacatgctatacttttgtctgtgcttgaaacgagcaatgccaacattgggaacaatgacagaggtttgcatcagtttgtcttggctttgttaaggacttctgccagaaatgtgctcgtggttgacaacccaggatcattgttcaagttcttatgcagacacctttgaaaacaattcagatcgtgtcacaagaatttggaattgaaaatatcatttattttttaatgcaagaatacccagatgtggtttcacttcagcagtagctatagtggttcacttatatacatttctgtttcactgaatgtaaattttgaatactgaatgtaaaaaaaaaactccagttatattgaaacagtcactaagactgcacatgtgttttgcagactttcttcctgaccatttgccacatgggtctctgataagattctgttggtttaatagtcaaaataatctttgcagtttgt

SEQ ID NO: 9583 - DNA, 1169 bp, Homo sapiens
aagtaccacaccccccaacctctgattctttcactggcagtgattcaggtggagattccgcattgaggaagtgtgaagaccctgctgtgtcatctgttagtgagcagacttcctccttagttctgcagccgccatctgccatgctatgctttgataaaaatgattttccaatctagacggccatgctcaggtattctcaccattaaatctgttcgaaggacaatgaacagggaaccaaagccttttgtgaaaatcttaatatctttatggggtattttagctttttttgaatgtgttttgttttttatttttaaacttgtgtaatttgaatgtttcattgtcagcaatgtgaaagaacggtcgagatgtttgactggattataaaatatatcactggagcaaagggaagacttttgaaagcccctttgctgactatctacctcagtttgcctcccggcaaactctgaagacaactttgttacctcatttgttgttatagtttatctcagctacataaccaatgatacttcctagtagtattgtgttttcattgctgtacgtgtaatgtgtgtgatcaaaggagtcatataggtagatgagtaagaatgtttatctgaagctctgatttttttaaaaaaagaaactatgacatctgcatggtttggataagttcatacctctggctgtgaggaccgttaaaccactgagaagaggaaaagtggggctatttcttctaacgatgaccaaaacaagaaagtatatttcttttgagaacagaactattcaataccaggtagggatcattttgcttaaaaggcctttatgttttgggcattagagtctgagtgctttatctcctatatcccaaacctcaagctgcccagaactgtgccttttctaccttcccctttgcctgacggttggccaaaggctgcactgtctagtttgcaaagcatcctcaactttgccagtattagttgcaaaaccccatgcagaatatggatttttaaagaaaatgggttaaggtggttttttttctttttttaaatcccagtttggcttaaaggagtgaagacatttcatgaactattaagaatgaaggtaaatgcaacagtagacagtaaaatgaactcgaagttattatggtaacagtgcctttcagtataatg

SEQ ID NO: 9584 - DNA, 3012 bp, Homo sapiens
atcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaa

SEQ ID NO: 9585 - DNA, 1058 bp, Homo sapiens
ggcttgagaaggatgggaaatttgttttttgttgttgttcttgttgttttgagacaggatctcactttttgccgaggctggaatacctcagcctccccagtagctgggaccacaggttcacaccaccatgcctggctaatttttgtatttttttgtagagatggtgtttcaccatgtttcccaggctagtctcaaattccttggctcaagcagtctgcccacccagcctcccaaagtgctgggattacagaatgagccactgcgtctggccacaggaagttttaaaaatagccactttgaggaataaatgagagagaacagactgtgcacatgtacattttctggccaatattgagatctcagtgaagagcccgtgattgtgtagtggtagaaacttgtgtggatgtgggattcctccagtagcatccagaagctgaggcataggaaaggccattggccctgcccatcaagtttttaaatacatcttttttctagggattctttgaactaataccacaggatctcatcaaaatttttgatgaaaatgaactagaggtaagacataacattttatgttgaaacagaaattgtgaacccattattttccttgtttataatttgacatttcttatgtagcttcttatgtgtggactgggagatgttgatgtgaatgactggagggaacatacaaagtataaaaatggctacagtgcaaatcatcaggttatacagtggttttggaaggtaatttgaaacttctattttcataacttactttttgatagattgaatcatatttaagtcaactcttgattaactatactggtggattacatttaactgatacagaaaaatatacagaccagaaaaaattatctttgattttatactgtatacatgcaccttctgggtctgtaactattactaggtaagtaaaatgttcagaaggtagtaagtggaatgacaggctgagacaggcacttagttttctactaaagtagggactgaaagaacttgtaataacctgcagggtattcctagggactcctgggtggctc

SEQ ID NO: 9586 - DNA, 1119 bp, Homo sapiens
gactcgttccatatttattttagtaaaactagtattttaagttttcttagtttttaacttttgactggacttaatttaaaacaccaagtttctcgtataactacaatatgtatactttttaaatttttctcgctaaaataacatatcaagttattgtgtttaattttagacacatcaacatgagctgaaaaatggtggatcagaaatagttgtcaccaataagaacaaaaaggaatatatttagtaagtattttattagtatgtattttattggatataattttgtactttattccagaaagactcttcttaccatctttctctgtccccttgtccagaatctcagtgttctttttctctatcacaatgcagtagcaagcactcatattcagcttttaccttggtctcagctagcctttagtttttgtttctaactagaataattgtgcctcagaattttgtcttggttcacatgaaaatgaaatgttgtttctttttagtcttgtaatacaatggcgatttgtaaaccgaatccagaagcaaatggctgcttttaaagaggtattcattttcttttatttgctcttccataatgtcacagtataacctataagtttcaaatattaggcctcatcacatctgagaaaaataagtatatggcttgttttgtgaaatcattctaaattatatttttatattaactaaatattccattcagtcattcaagaagtctagacaataaacatggacaggtcccctttcccccaagccttttccctattccattctcttcactttaggacagcaaaagaacaagagtgctttagggatagtataacatattgtttgtttttctaaataggatcaccttacacattttgttttgtgacttactttcttcttttttttttttttttgagcgcggagtgagtcactttgtcgcccaggctggaatgcagtggcgtgatctcggctcactgcaacctgcacctcccaggttcaagcaattctcctgcctcagcctcctgagtagctgggattacaggtgcccgccaccacgcctggctaatttttgtatttttagtagagacatggtttcaccatgttggtcgggctggt

SEQ ID NO: 9587 - DNA, 1191 bp, Homo sapiens
tttaggccgggtgccatggcttatgcctgtaatctcagcactttgggaggccaaggcgggaggattgctagagcttaggagtttgagaccagcctgggcaagatggcaagacctcaaaaacttaaaaaattagtcaggcatgatggcatgcgcctgtggtccagttacttaggaatcggaagcaagaggatcacttgagcccatgaggtcgaggctgcagtaagccatgttcacgccactgcactccagcctggactacagagctgtctccaaaaacaaaagcttcttcagatgtaaagaagtctatattactaagtgattaaagaaaatgcagaaactgtctcataccatagaggaaaccaagacaatatacctagttgtgttttccctgagtatattacgtaaggaaaaagagacttggacacagggtgtagagggaatgttataactttatgagagatgggtttgttattatgttgaactgatttaaacagtacgtctctcctctggattttcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacgtaagtacctttacaatgattatcggcagaaaaagaaaaatcactgttttaaaagtaagagtcggccgggtgcagtggctcatgcctgtaatcccagcactttgggaggccgaggcgggcggatcacaaggtcaggatatcgagaccatcctagctaacacggtgaaaccccgtctctactaaaaatacaaaaacttacccaggcgtggtggcgggcgcctgtagtcccagctactcaggaggctgaggcaggagaatggcgtgaacccggaaggcggagccgagatcacgccactgcactccagcctgggcaacagagcaagactcctctaaaaaaaaaagttaccattttagccattttaaatatacaatttagagtcattacatacattcacattgttgtgctgccatcccactatccaactctagaactttttcatctt

SEQ ID NO: 9588 - DNA, 1159 bp, Homo sapiens
cctgtaatcccagcactttggggaggccaaggcaggtggatcacttgagattaggagttcgagaccagcctggccaatatggtgaaaccctgttgatactaaaaataaaaaaattagctgggtgtgttagcacatgcctgtaatcccagctactcaggaggctgaggcacaagaatagcttgaacccaggaagcagaggttgcagtgagccgagatcataccactgcactccagcctgggcaacagagcaagaccctgtctctctctgtctctctctctctctctcactctctcagaaaaggtaaatatatatatatatatatatatatatatatatatttctagaaaaggcaaaactgtagtaacagagcagatgagtggttgcttggggctgagagtagacatagggacagagggaacttttgggggtgatagaaggattcttaaacttgatgtatttaattcttctgttattcttcactttagcttttgcctacttcatctggattaccaccaggttgggaagaaaaacaagatgaaagaggaagatcatattatgtagatcacaattccagaacgactacttggacaaagcccactgtacaggtatcctgtaatctatcaacttgctttcttacaggatttaaactgtcacatccctatgtaaactattacatcactttgtaggatacactggatacttctaccaccttcttttttttttttatttttttgagatggagtctcagtattgtcgcccaggctggagtccaatggcgtgatcgtggctcactgcacctctgcctcctgggttcaagcgattctcctgcctcaccctcctgagtagatgggattacaggtgcccgccaccacacctggctaatttttgtatttttagtagagacagggtttcaccatgttggccaggctgatctgaaactcctgacctcaggtgatccacccacctcggcctcctaaagtgctgggattataggcatgagccaccgtgcctggtcatagcatcttctaattatttatattctgacactgatgttaagtgtctaccttttcctatgaatctctaatatacacgaattaccacttgttattatataaaacaagtacaaatgagaataagaggaaaaagcaaatgatctcg

SEQ ID NO: 9589 - DNA, 1286 bp, Homo sapiens
tcttacaccatctttcattctgcccttcacattcatgcatggagtactctactcctggcttaagaccaattctagaaaatgtactatctgattcacaaagatgtatgtatgtgtaactctattactcttataataacatggcaaaataatacaatgaaataatctatgaagcgctctgatatttattcattcaacaaatatttttgagtacctatatgtgttggacattatcctagacatagtgacaaactaaaatatcaaatcagacatgttataccttttcacaaaaccttaaactccgtaaggtactctaaatataccagtctgcctacccatgattgaatctttgcatgttgaaatagcctttggtcaaagacaataaatttttttattgatgtaatgtagatttttttcccaatgatcacagaatctttgacaatcattttaactacttaagacatggatgatggctttttatacttccaatatagggacaacctaacagatgctgagaatggcaacattcaactgcaagcacaacgtgcatttaccaccaggcggcagatatccgaggaaacagaaagtgttgacaaccgagagtcttccgaggtataagtagtttcctagttctccttgaaagacacatgctatagcaataaagtatgtgtggctcaagcttattctgttcattttagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcagtaagatgctcttagattttgttacggcttcagtagtttatattatgcatattatactattcaacaactaacttttatgtaaaattttgtcttaaatgcaataatatgtaataatacattagggaccttgggactttacaacatggtcatttttcaaatatcctcattagtagtatggaccagagtcatggcatccaaatttccattatgtcagtgccctccagtcaaaaatcactagggacacatttgtcattgaacaagttgggtttattattcatttcagcaagggagaacacgcaccattggtgttttggtagcagaatgttagaaaagacttcagggatttgggctcctgttaggtgattttgaagagggttttaggaagcaggactttgctctacatgagatgctgttgggaagcag

SEQ ID NO: 9590 - DNA, 1184 bp, Homo sapiens
catgttagccaggacggtcttgatctcctgacctcatgatccgcccgcctcggcctcccaaagtactgggattacaggcatgagccaccgtgcgcggccacacctagtttttgtttttttttttttaagtgaaagcagtttgcctttactttataagaagagtttacacccatgagataacttgagacaacctgaagtcttacaaaaccagcgtcagaatcattgaattaaccatcttatctcaaaagaagaaagaatgtaataaaaatcaaacaaaattttaaaaatctaggaagcttataatcattaggcctgtgattaaaaggttttctttctagttctttgtgtctttcactaacatggtacttcaggtttttaacgagatgcaaaaattactttaattgcttacctgcctaagaatcctgacttttaaattcaggaaataattgtagatataactaacaaggaaaactgtgaattttatagtctgggtaatctgagcttggggtaagcaataattaaaatttttctttctttttttttttttttttaacagtgatccttacgtgagagtgacgttatatgacccaatgaatggagttcttacaagtgtgcaaacaaaaaccattaaaaaggttagacttagcaatattcaaaagtttttaatgtactttgttttatttttataagacaaaaccttatttagttatactatgtttattattttttagagtttgaatccaaagtggaatgaagaaatattattcagagtaagtatatattttattttactaaagtggaaaaagtaagtttttttcttaggaggttagaatgataaattctcatttttaatatttgaagatgtatctcagaatttgcctaaagttgtgaaaatacaaaaggaattgaaattttgtcttataaaaaacataaatgtaagataatggagaggtaaaagactagaattatcttattctagtaaaactgatttagagactgtacagtagtcttactccagttgagcagattcagtgttttctcataaagatgatgcaaattatatttatgtctccccagtcatttattattaaacagattagggcctatcaagtgaatgcatttctttttatccacacgtcattgacattgctgcctttccaccccatctgcctcatttaccataa

SEQ ID NO: 9591 - DNA, 1035 bp, Homo sapiens
ggtccccaggtccagcttcttatgggaatgacacccttaaccgacaagaaagcgctatgattttccgtttgggatttaagcggggattaagctcacggattcccaggcgtctagtcagaggccgaactctgggtcggatctcagcgagacttgttgctgaggaacactgcagcttggcttcccggcgcttcccggcgctccctggctccccggcgggcccgtcaaccacccacctcccgggaagggaccgagggcgcgccccgccacgcgcgctccccacgccatggtccccgccgcgcgcgctcatcccacccgagccccgccgcacgccctccccactccccgagccccgccacgcgcgcccccgcccagccccaggagcgcgcgccgccggccttttcccgccgcgctgccgggtgccgctagtgcccgctcgccgcgggaggcgctgctgtcgctgagggagcgcctcctcctcttcctccaactcttccccgcctcctcccgcttctcctcctcctcctccacagttgcctgccctgggcgggggcgagcgcgtccggtttgctggaagcgttcggaaatggcaacttgcgcggtggaggtgttcgggctcctggaggacgaggtgcggggaccgcggggctgcggggcgggcttcccttcgggttattcagcagccggacccggggaggtagcggcggcggccacgaccggaggctctgctgtcagcccctcctccctcggcgcgagcctggggagcgcgcgaggcgccgcggggactgtgggggcggctcggcgcgcgggcgctgggggctcgctggagggagcaagcttgtcgggtccacacccgccccttcccggagcggccgccgccttacttgtcagtttccttcaggaagtgttgaggagggggctaggcggtcggcgggggacccacatcaccgcgccagccccttcctgccacccccgccgggtgtgcggagctcccaggcgttgggagacggtcgcagcatccccgctgttgatttgctt

SEQ ID NO: 9592 - DNA, 1139 bp, Homo sapiens
acatagatgcgcaggcacgcacacacaaaacaagcaaatgtaactccaggcatttgtaatttaatataataaatacaagcatgttagaaaaatgctttatgtcttattatttgttaagttaggggaatgagaaggaaaacaaaagcattctcttagtttcatcacaatggctgcatgtacatattgagattctaactgagatttactttgaaatttttcattaaaatattccacaataatcagtttttttcctcttcaattgagtgactgactccctcactcctcctgaatatagtaatgtagtttgatcataggatccctttgaaaaacaggaaggaggataacataaaaaacaacaaaaaacatttcaccacctaaggtctgaagccacaaatctttatatctctgatgaaacaaaggggatatcaatagtacttgaagaagaagagcattttattacttgcttaatttatttattgtgataaccacaattgcaaaagaagaactcaggatttgttttaaaatgtttctctctatggctcccattttgttttgtgaataattatttatgagttgcatgttgacacaaacctactcactggttgaaagctccatttaagtgagtttcaagatcactttcaaagagatttttaaattgccattgtttttaaagctaacataaaaccatttgctatgctaccttgaacctagctaagctttcctttaccttagtaagccaatcagaagactacaatcaatgaatatttagcaaatgtgctgaagggtttaataaggttttgttgttcaataaatttgcaaggtagggtattaacatattttgataaataaatggtgctagagttggcgcagaggtttatatattgatatgtcttagttattggcatttgtgtgtgtttgctgttatcttgatttcatgatttgttaggtatttttttcttgatgctagttatttcttcactgtacattgagacacagcactactgcacaccaaagtatgcaatacccaaaggaaactgtgtgatttctcctgacaaatgatgggagcctttctttatgagatactctgaaaaggagattttgaggccattctaatcccttgtttacattattagcttcct

SEQ ID NO: 9593 - DNA, 1644 bp, Homo sapiens
gacctggaagacgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaataattctatttttccaatcactgcttgattcagattacctttggtgcctttagaaattatatacttgttcaagaaatttaatatcagtgttagtggtgaggattccattctacattctttaactgctgatacattattttaaattaggacttaaagtacaggggacaatattgctaatatttatgagaatagatttgctttataaattcttttacttcaagagaaatagaatttaatattatacttttctatctgcccaacaatttaaagaggctaaataggcaaaatatattat

SEQ ID NO: 9594 - DNA, 1508 bp, Homo sapiens
tacctaacacaatgtaattgctgtgtaaatagttcttatgttggattgtttagggcataatgacaaggaaaaaaatgtctgtatacattcggcacagatgcaaccatccatttttttcccctaaatattttcaaattgtggttgattgatttcacagatgtggaacccacagatagagggcagactgtatatattgttgtaacttattttaggcatgttaactcatttaacaggttgggtctaattgctcaagtatattactgtcaaacctctgcttataagcatttgacttataagcagaccaagtgtcttcccattgctgctggaatctctttgcttaactccactttctgtatctcagaacttaaagggcacctctggtaaagcttctgtgttttatttccatttcattgtagattgcataggtttcagtggatttgtctgggaatttaagcccaagtacactttttttctgtatatttggtacctcaaataaccaaatttcaaagaaaattcttctgtaaacttgatattgcttgcaatataacctatgaaaaattctgaaatctcctagagttacaaaatatgtagaatcaccattttcagactatcaaagggtaatacaaccctgccctcaaaagttaactcttttggcttagtggggtggctcacattcccagcactttgggaggtaggaggattgcttgagcccaggagtttaagaccagcctgagcaatatggtgaaaccctgtctctacaaaaaataaaaaaaattagccaggcatggtggcacatgcctatggtcccacctacctgggaggctgagagggaggattccttgagctggggaggtggagattgcagtgagccagatcacttcactgtattccagcctgggcaacagatccaaccctgtcttaaaaaaaataataaaaaataaaaaaagatatgtagtttgatatacttgaaatttcttcactagatgagatactgaaaatgattataaagtgtcgaagggaaatagtatctgatttgacagtgtttcataaggatgaggccttttactttttccagtgttttaataaccctaaatttcatgaaagaatatgattgtatattcattgatctacattctctgacctttggctgtgctgacaaacacaaaatgttggcaccaagagaaacttgagagaaaggagcctagatacagttgaaggcactaaagccaagaaaaatgaaattacttgttagtttgaaacatggccctggccaggcacaatggctcacccctgtaatcccagcactttgagaggctgaggcaggtggatcacctgagttcaggagttcgagaccagcctgaccaacatggtgaaaccccatctctactaaaaatacaaaaatacaaaaaaaaaaaaaaaaaaaaaaaaaaccagtcaggcatgatggcacatgcttgtaatcccagctgtgtgggaggctgaggcaggagaattgcttgaacgcagga

SEQ ID NO: 9595 - DNA, 1146 bp, Homo sapiens
gatctacataattattaaaaagcagacaatgtggctgggcgcagtggcttacacctgtaattccagcactttgagaggctgaggtgggtggatcacctgaggtcaggagtttgagtccagtctggcccacatggtgaaaccccgtctctactaaacatacaaaaattaggcatggtggtgcgcgcctgtaatcccagctactcaggaggctgaggcatgagaatcgcttgaacacgggaggcagaggtcgcagtgagctgagatcttaccactacactccagcctgggcaaataagtgagactccatctcagaaaaaaaaaagaaaaaaaggccgacaatgtgagggtggagaaaaaaagagaaagtaggtatgggctgaaagcagtggtctaattgaattcaaaacgtacttaatgggtgcgttctaagttaagacattgctgaagttgtaaataattcagaagtgatgaaattttcaggtttgggtcagtatcagcaggaaaataacttgtttccttggccttattttatagtctagtctcctgagacaagatctggggcttgggagcccagcacagctatcttcttcaggaaaacctgggacagcatactattcattctctgctacaagttccaggaggagaccactccatgactctgcagcgcttggtgagtgtatcacacaacaaatcccatcccacatatgttgttgttgttttttcctcccataatctgtacttctggctatgcttttttttttttttctttccgtttctttgtttaagacagcgtctcactctgttacccatgcaggaatgcaacagcacaatcttggcttaccgcagtctcaacctcctgtgctcaagccgtcctcccacctcagcctcgcaagtagctgagactataggcatgtgccactgtgcctggctagttttttattttttgtagagacagggttttgccatgttgtccaggctgctctcgaactcctgatctcaagtgatctgcccacctcagcctcccagagtgctgggattacaggtgtgaaccaccgtgcccagccctgtctgtgcttttaattagaagagagttggattcgtgggtatcacattgatgtcagggcttatttgcacaagaataataca

SEQ ID NO: 9596 - DNA, 1227 bp, Homo sapiens
gaagtggacatgtcagaaagcgagggttatgaggacaggttctggattcagcctgcccgaatgcagttcctcctaagtgatcttggacaagttacttaaactatccaagtgtcagtttcctcatatttaagatggcgataagaatagcacccgccttctggaattgttaaaaggtcgaaatcccgtgtaaagatcttaacacaggcaagggttggcaaactttttctatgaagagccagagagtcaacattttaggctttgtgacaccataggctttggggtttctgttgcaaccactcggccctgctgttgtagcttgaaagcagccacagacagtctgcaaatggaagggcgtggctatgttccaataacactgcgcttttcaaaacaggtgaggggctgggtttggcctgcaggctgtcgtttgccgacccctggctcagcacagggcctggctaagtgggcacaatgggtttttcataaatgccagccattcttccagcctggggacagctccttgacatcagtctccttgttcatttgctttgtgtttttaacagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgaggtgaggctcgctgggcccaggcccagctttggcagctgctgctccttctttcctgtgtaagtgatttcaaaagtggggaagggatttattgtcatgatgtagtaggaaaggtcaaggcaatagtgaatacatcctctctgcaagccatttctttgttcccctgggagtggcatgacagggaggccagggaacagggacggtgaggtcaggcgggaacacaggtctaggcacaggaatccccacacacccagataccagacatacccagccttccatggcttcacacaggcatccacctgaaagggctgtcttaacaccaccattagaccgattctcactcaagactatttattcttttttaactcattgttgatgtttttgaagtgacactgattttaacaagccaattatctggttggccagacctctagcagtgggaagctgtgactgagagatggca

SEQ ID NO: 9597 - DNA, 1191 bp, Homo sapiens
gctggcaggctttctgtattctgggagttgacacgagtgtctgctgttttctgacatgtattatgtaccaggcactttactaactattttgtttctaactagaattttatctgtatctgctgataaaattttatctgtatctgtggatactaattctgacaacaaccctgtaaggtagatatgatttcggtgtttccagtgtggacatggccagggcccagagaggttaacgacgtgccccagtcatgtactggtaagtggcacagcagccctaggaccctgaggctgtgtgcctggctccaaaggacgtgcctgctcactcctccatgctgcttccaagtcacaggtgcccacacctggctgactcaggatcaggtgctgggccatctttgagggggccatagaagaaagggagaagaggagatgtgctgtgtgttgaaatgggacccagaccctggtctcagagcatcccagggtgggctcacacccgtgtcacttcttctagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgaggtaatgcctggccagataagttcttcctttatcccttattcaaagtatcctttgccctgaaagtcttctgtgagggacttgggggtagattcgtgagacagctttggtgcttgactcttcattcttcaccttctggatgggttccgtgggcaaatggcattctggagcacaaaggacccaccggcggactgtgaggctaaatggacacagctttaacctgaccattttcttgatgaatctataattttttgcctaaaatgtttagctgccatttatggagcagccatgatgtgcccagctgtgtccagatgatttatttatatgctttcatgttttaatttaatcctagaatagggattacagtaactgactgttttttggccattgatttttgaaaatacagacttttattggcatgagggtggcggacaagagtttcacaacaacaataatggcgagtaaaagaaatcctcaggaatttatgagtattgaaatgattaaaacattcgttttat

SEQ ID NO: 9598 - DNA, 1187 bp, Homo sapiens
agggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacagatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagca

SEQ ID NO: 9599 - DNA, 1089 bp, Homo sapiens
tgcccatgcaaagagaacacaggtcacttttcaaaacacttgcatcattaccctaaaaataggctgttatgcgttttgacaattgcgctatcctacactctgagggagttggcaacgcatgcggtatagtggagtgggaagagttgagactgaaagttaagagaagggttttcaagtcccggctcatctcaccccagtgactttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaattttgactctcctgtgattgtgacttctttgttttctccagagcttggctctgtgtcctttaagaaactgccaaggtgagtggctgggagctactgagggaagtggaacttggaggccttccagccctgggaccggtttctgaaacagaagggtggggactggtcagtggtgaatgctgagggaattaatggctctggattcttgtgatgttctgagaaatccaaactgcccgttccagaacatggcaaaagaggaagcatgttcaatgttaattacagaataagcaggagccccctgtttaccccttttcctaaattcgaggtcttctgcaatcctagttggcccataatctctcttgatctcacaccaggcccatagcaggcaccacagtctctattttacagaaaccaaagcagcttcctcatggaagggg

SEQ ID NO: 9600 - DNA, 1475 bp, Homo sapiens
acatgccatgtagcctctggaaaactccactgtacccatgcgagaaaatgagagggaaataatatcttagtattattatgaaagtagttttgacctaataggcccatccccacactccaccccatccccaaattttggagattgcactttaatgactgctggttcttggaatgtcttatgtgattattatatgcttaaaatacttttgctgaaattctaatttgctgagacaaatgaggcatatattccctattcttcctgcattcccttgttttttgggctatttggataatgaccattttaattgttttattcttgttttggggcagttagaaatcagatatttgacttaaaaatcagcttttctttctttgaagataatgccttgcctttttaatgttatatctcaagttaaaaaaatggctgtaatgtaatagtattcttttccatttgacagaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgtaagtaccctcggaaacaggcctgtaacaggaacgtgatatttgttaaactcaaaaatttacgagaaactgggtgtggtggtgcttgcctgtagtcccaggctactcaggaggctgaggtgggaagacagctttgagtccaggagttgtagaccagcttgggcaatataataagaccttttctcttaaataagtcaggagaatgctctaagttccgtgggctttgtatgagaactacttgtagttaggaaataacatgttgtggcaacactgagaccagcctggccggagtagaagattcatgttgaaaaatatttagttttgaaaccaaataatcgacaaggtcttttaaagcacatgggggagtgttaaa

SEQ ID NO: 9601 - DNA, 2239 bp, Homo sapiens
cctcgtgatccgcctgcctcagcttcccaaagtgctgggattacaggcgtgagccactgcaccgggccccagcattagtcatttttgacatttgataggtcaaattgttatgtgagtgtgtatacatgtgcatgtgcccccatatttaacgcatctgtatttataagtattgtagtgctaagctcattactcagtttcttatatagaggagtgtatttcagtgcaatgttgtatattaatggaggtcagtaacttcaactgtagcaggctggtggctgtcagaagcattacccagttgtgtctgatagggcacagccatcaggcttgtattgcccaagggagcactcagtgaggtgtcagtgtccctcttattgctgattctaggtaacttcccattgaaaaattgtaaggaagagatgtgaacgtgtaactttgtgctttgctctttgttttaaaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaa

SEQ ID NO: 9602 - DNA, 2239 bp, Homo sapiens; identical to SEQ ID NO: 9601

SEQ ID NO: 9603 - DNA, 1206 bp, Homo sapiens
taaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaa

SEQ ID NO: 9604 - DNA, 1253 bp, Homo sapiens
cagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaac

SEQ ID NO: 9605 - DNA, 1264 bp, Homo sapiens
tgctgctgctggtttggggtccacacttaagagatctgctgctgtagtccacgtgcagatccacaactggcttctgaagtaatggggcttcaaagtgagattgcccaagttcaaatctctgcttcaccattttattagctctgtgaccttggaagagttcctcaacctccagatctgtttcttcagtaaagtggggttagcaatggttcagacctcacgggactgttgaaaagagtaaatgatttattttggataaagtaccaagaacagtgcctggtatttgcagtgatgatttgttctttgttctctgatgtttttttcttttaaacctttttcagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttcc

SEQ ID NO: 9606 - DNA, 1166 bp, Homo sapiens
gccaggctggtctagcacttctgacctgaagtgatccacccacctcagccttccaaagtgctgagattacaggcctgagccaccactccccgcctcttcttatctttaaaactgtggaagcactgattgctttggatatgcctcaactgttaagaacagtaaaacattcttcagcttggtagtgacttttgagtgttcggtatcatttctcctgaatgctaaaaaaccaacctttaggctagacacttagttcagtttaaaagaaaatgagttgtaataatcaataactagcttttttccatggctttgccttaagttcattttttggtttcattattgtaggttatgcagacaaagttaagaagaattaagcactcaagtaagcacttcttggacctatattctttgtttctaatcaataggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaaggtagctgtgtactatgtaatgctttcctagtggtctcatgcattggggttaaaaaaagttaagattacagttttgatcatgtatgtttttatgttttgtttaacagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacaggtaagtgctgcgggaggcttgccgcgagcctgcacacatacatttagaggattcatgagctactctggatatacagtagcattttgatgtggcttagattagctagattggaatgattcagaggcattaattttttatttaaatttttaaaatctgaatttttctcatactttactgt

SEQ ID NO: 9607 - DNA, 1173 bp, Homo sapiens
ggacaaacagatccaatcccaacctatgttcctcttcctaattgacatttggcacagtggtagatttcaaaacaaatacatttcaattagttatttgcatatttttcaagaacagacattgatgcagcagttgggagttctttattattagaaataaactttgttttaatgtataagacttccgaagtctttgaagttaaatcaacatatggcacatggaaaaatgaagccgtattttttggacagcttctagaagctggcttggtaaatattaaataactggaatttagagcatctctagcagcaatttgattagtgtgcattttagtgtgagaaatttgagaactcagattcgtgtttgatgatcttggtattagacctatttttaaagacacagtaaatatataaggtaaaatgaatgaactttgggaatattaaaatatgatcaaatttgacacatttaaaggtgtaaattaccaaaaacgtttggtggatagcccacactactttgcctctagttgtaccaaattttcttaccattaaaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggtctttagccagttttttttaaaacatgacacagataaattaagttttaaataataaaaagtatttttttctagttcaatttggaagtctcagaatttttaaaagatgtgttactaaagctacttataagtcatctaaaatcctaccaccttaggcaaccttttaaatttttgcttatttcatataatatatatttatacatagttgttatagagtaagttcctatttattctgtattttcacatgacgtataatttcataatttccccataatttattagactgctttctacatatctaatagacactcctttaattttggacattttaagttttaaggcttttttcctactccacgatgaatgaatgtaccaatttcattctggcattgccaacattacttggtggtagggttttttcccctttctg

SEQ ID NO: 9608 - DNA, 1499 bp, Homo sapiens
aataggttttgaagtaattgtttgatttgaccaaatatgttttgttgctgaaggtagtgagatatgcaataagatcagtttttggttaatagaagtttttaagtaggcttatgctctatatctactgtatttctaaaaattggatgcatgagtagagtgaccagagaaaaacgttttataagaatagtaaaataattcataacagacattttgtgtactgatgaggaaaagacagttctgcctttataagggatcttcttggtggaatttgagaactcttcaattaaatagtataataaaacacattaaaaatcttttaaatatctaattttgtcttctaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggtaaaaatgtttaagctgagtaaaacatggaacctattgcattgcatttgtgcttaattttttgtttgtgtcttactgattttatttaaagggactatcaggttctattaacttttatttttaagtcatataaattaccaattgcagtattaaaccatgactctaatgctaagataaaaatttaaaaaatttctagtgacaaaaataagtcagagttttttgggagaataacccttcattacttttttttttctgaaac

SEQ ID NO: 9609 - DNA, 1159 bp, Homo sapiens
ccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtaaggtttgtgaaagtcaggtggcctatgtccctttccacagaattgctccatgtcaggaggtcacccacatctaactcctacctcccaggcagtactgcatttagaacaaagctgtctgtcttgtctattcttaatgatcgccaaggagacagcttgcagaaatatcctaattaaatttattccagtgtttgataacagttactgttagtgttatgtttaatctaaatttaccttgctgattattaaatgattttattttgtttggctcttaatgaagagagagaagaactagtcgaatagtttcactctataatctttcatatctttgaagacagctattaagtcaattactaaggtcagactctgttgcttcagattaaatgtttctaggtcataatgattatatgtaatacagtttattactcaaacaatttaggcatttggattgctcctcagactcccctttttactgctgtagttttctttgaaatgagaccaataaaaggccaatattgtctatttttagaattggtagatttactgctatttattgagcaatcacagggaccacacagtttagttcagaaagcttcagatcatttagggcttgggtttccctcactacgcaatgttcatatctttcacatgtaatgactgaatatatgaatactaatagatatatggctagattaaggaaaacttttgcttcctgtgatggagattatatctgaattatgcttcctaaaattaaacctcatttcttttttttccattgtcagatttgtatgtatgtatttattttaaccgctttattgagatataatgtaaatgtcacaaaaagtgtaaaattaaatgatttttagtaaatttataaaattgtgcaacctcaacacaattc

SEQ ID NO: 9610 - DNA, 1316 bp, Homo sapiens
tctgtcttttgtaaggggaaaggatttaacatttagaataaaccccaccatttatgtaatggaaatagtttaaaaattgctaactgccatgtggattgcaaattaaatggaaacttatttagataacgtaaggctcaatatctgcgttgaccacctagatattacaggttttaatatttaaaactatttttgaattatccacaacctgtatagtgatagccatatatttaataatggaatggtggttaacagtctatttactgcacaattaattgttcactaatcaaatagaatgtggtaatttttcagactttatgatctgtttccaaaattggcacaaagtgctagggtttatatacacttatcgtaactgtatttttgtgccttggttttatcatgtcaatgcactgtactctgtaaaagttttgcagacaaaatagaaagtatgataatccgtcagaagtatgatgtaaaactggaatcctctgtattttttaaatgttctaaaaattttatcgctgttaaggtattaatcattcagtattactaatggaatagaaattcatacttttgtatggacaacaattcaaattgatattgcatttatagcactgtaagaaactttcatcttgagcaactttgtagatgatgggtgttttattttcaatcgccatatttgatcagtcattgaaaattggccccagtgctgtttgttcatctctgtatgtaaaaactgacagtgagacacaacgttctgaactgtgagggtgtcccaggaaaaagaaaaacaggaatactttaacaattaaaaagaaaaaaatgttttttgtttgccaaggactcaggaaaataaaaagcattttctatttttaggacaaatcacaaatgaagtgtctaactggctattactgtttacccatataaaatatgctgctaaagtacatattttgctgtcaatggcttgacaattttttttttcaaatttggacatgagaggttatatagggactatattatccaacacatattttcttattttgccacaaatttccacttaacaaataaaaaaaggcgaatgctgttttgcaatcagaaagtgaatttcttttgtggtagcgtacacgtggttcatgtggttctccacgtttaagcacaaaccacagcacaggaagccacaccccctccagcatctctgtcttgtggggtctttgaggagaaggaatcagaacatcgacacctgggaagagggaggcggggaacaccagctggactctggccaaggagtgatgtaagcaggtgacacttggctgtcagct

SEQ ID NO: 9611 - DNA, 1193 bp, Homo sapiens
aaacagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtt

SEQ ID NO: 9612 - DNA, 1700 bp, Homo sapiens
atgggacattaattctctgtagaatgtagtttaagcaatgccatttaaatatattggaagatctcataaattaacaagagaatgatgggtattacagtggaaaagtggtcaaagaacaccaacaggtagttactgaaaaaaaattaaattggtcaataaagataaacatatgaaaaatattcaccttattatccagtgaagataaacattaaatcgaaatttttaattttttttttttttacttattaaatgtacaatgattgtgtgttactctctccaccagcaaaggtacatgcttttacatgttaatgaaagtatgaatcgctttttggctctctcaccagcaccatggctgttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcgtctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaaaaatcagatacggaagacctcttatgctcagcaccaacaggtccgccaaatccggaagaagatgatggaaatcatgatccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaacgtgctatttgtaaaaaaaaaaaaaaaaaaaaatcccagcatttcggcataagaattctgcctgtttagttttgtctaatttataaaacagaagcgaataaaagtttgtaaataaataattagttaattaaattataacttgtccatgcactagaacacaatgcagcctttaaaatattacagaaaattatataatttcattaaaaatttcacaaattttataatgaaaaaacaggctttaaaataatataattttatttaaaaaattaataatgcctttactttaggtggttgaatagaatttctttgtactgtacttatttttattttttaaatattattttttaaagcaatgaataatcattactgagattctgaaaataatttagtactatatatgaatataaaaatatgaaaatattttaatatttaacattttaattagttgatcttgcagcaacctggcctaaaacaaatatgatatgtatacaaatgtttaaaagccacaatattacttaaactattat

SEQ ID NO: 9613 - DNA, 1232 bp, Homo sapiens
agaagttcctcagatgtccaaaggcatgcccatggttagcaaggataaagttagagctggattttttgtagccaggtttattagggcacatgtttaaagtcaaaggaccagttagactcttagtaattgttcctcacctcaccagcttatttccacttgaccttaataatgcaggaaataggagagtgagctaggaaagtaccctgttttctgtggaaagacgaggacgagagaggaaagttagggtgtttgtaggaccttgctgcagtaagaacagccctggtcactaacctatgtcaatcctcagcaccttgcactccctccaccccacagtcctaaggagccttgagtgtcttccccagcacctcctccgaccacactcctggaggcttccctggcaatggtttgggtgtggccttccaggcctttgtatcagggcaggtctcctgcagagtcttctctttgtcatgggagaagcttcattgtgcgttgaggctacttctgtgttattgaggagtctgggcttttttctgataccacgtttcttttctttcctgggccattgtagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcagttcctgagtcacacaatccacatttcgaatgctcagctttcacatgtggtcagcagctagtatatctggacagcgcaggcagggaacatttcgatagaaagttctgttgggcagcagtacatgc

SEQ ID NO: 9614 - DNA, 1196 bp, Homo sapiens
agatgtggtagtttgtaaatattccatttcttgtgctattataacttggcaaatttgcctgttatcatgaacatatcagtgggaagatgaggttaataatagctggtagtagtttgttgtcatcttaaacaagaaccttttacaaccattagacttttctttctactttaaaagagcaggaagtatgtatgacagggatagggacattaagagataggtagggtggcttgaaatttttactaatactttaccaatttatttacataagatgtcctgtgaagtcaacgagtgccgaaaaattgagagtcttgaaaacttgtatttggattttgatgatgatgtcacagaacttgaaacttttggagtaaccaccaccaaagtatcaaaatcaccaagtccagcaagtacttccacagtacctaacatgacagatgctcctacagcccccaaagcaggaactacaactgtggcaccaagtgcaccagacatttctgctaattctagaagtttatctcagattctgatggaacaattgcaaaaggagaaacagctggtcactggtatggatggtggccctgaggaatgcaaaaataaagatgatcagggatttgaatcatgtgaaaaggtatcaaattctgacaagcctttgatacaagatagtgacttgaaaacatctgatgccttacagttagaaaattctcaggaaattgaaacttctaataaaaatgatatgactatagatatattacatgctgatggtgaaagacctaatgttctagaaaacctagacaactcaaaggaaaagactgttggatcagaagcagcaaaaactgaagatacagttctctgcagcagtgatacagatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaattctaaacagccttctgtttctgagcaattgtctg

SEQ ID NO: 9615 - DNA, 1189 bp, Homo sapiens
ggcagcctatatttttacagctgggttttaacttaacaccttttgggatgctgtcttccaagagtatggatttgtgcttttcaactctgacttttggattttaaaaaatggagcccagagactgtgttggacacatacttataaatccacgaaggcttagcctacagaagccacaggaaatactatgatattttggaaaaggtcgagtttcatggattctgtaaggcactcagcaggttgtaattatttcttttatttaaaagccttccagatatttttttccagagggtctgcaattgaggggtagtagacatttttttcatagtgtacattctttttggctgagtgctggaaatacacaggaaattaagcggctttaaaagacccagcggcatccagtccaaggcatgaggtcactgaaacagaatgggagatctccaaatcagcagcatcagtttttggctgcctctgtccctgtccttgtgcaggagggaaaaaaatgaagcaggtgaacacactgacctgttctgttttaacagaaaccaaatgtcgccatgtctacaggcatggctcagcagctggaatcgctcaagaggtttagacacaggccaacaagacagatgtgttgaggcggccaggaaagtgaaatgagttgcctgtgtcttagttcaagatcctggtgctgctttgggccctggcctctctggccatgccgaggccaaggaaagcaggccagctccttattgaccagcctctgggctgcctcttaggaaaatcagatgcaaggactcttgcctcagaccagagacagaatcggccaagtttttggtctcagcaactaaaaacaaaaagaaaagatctgcttctgaggcagcaggtagctacccggacatgtgtctgatgacttttgcacaggaagatgcggatcctgggagtgacgggaacgtatggggagaggacttcacagaaggtgggctcttggcttcagcctagccgttgcctctgaggttggatgagattctgctggaatcctggaaagcagagaaaactcccctggaagcaaatttagagtgtgcgaggtcttcactccctgctgtctcattcggtttctttttggctgctttgggctgagtagagttaattttgagcaaagaacttcagccagcatgaatgaagcactcccaagacg

SEQ ID NO: 9616 - DNA, 1097 bp, Homo sapiens
tttaaagtagcagctgagacgctttatggcaacacaagtgtggttacttcatattatcggcacttgacttttaagtctctgtcacgtatatcaatgggtgataaacattttcttcttgttacctttttttatctttgtgaatcttggcttcaaggaccaggtgtacctgtatctcaggtgggaagattgaggctggagcaatgcctttataggaccatcagagaactcttctgtgaacagatttctgttgtgcatgatgtaccttttacatcatgcagggcattgtagcagatataggagttatgctttatttggtccccagcttcaggtgactaacagtccaatcagaatccatgcacacagagatcagcatgacacaacatgagaaaagaaatgttatgtggggaagtgtagcaaatggaacggccaggtgagaggccagagagatctaagaatgtcctgaaggaggtgagatttgcccttgaccttgatggagtggtcagacttgggaaagaagatgaataaagcctatataaactgagagttaagagtgaagactggagacagatggctttggcttaaatcgcagttctgctgcttgctatctgtgtgaccttgggtaagttacttaacctcagtttcccagttatgacatgggaatgataacaatggtgtcggtctcttgggttgctttgaggttatttgaaataatacctgtaaagcacacagctaaaaaggaggaatgatggtggtgatgcagggagaccaaagagtgaaacagtctagagtgaagcgaatgtgttaaaatccagaggcgatcaagtgaagccagcctttggaggcccgtagaagtcatttggaggaatttggacttcgtgcagtaggaaagagggaaaactgtttttagaaaaaaaaaaaaaaaagatttgtgtgccaaagtgtaacatgatgaaaatggattttaaggagaaactggtgtgtctgcaattcatctctcctgatcgtgtaactctctagtcgctgccccattcagtagatcagctgcacagactcctaattagccattccagtaggccaaagactattttttgagcagg

SEQ ID NO: 9617 - DNA, 1145 bp, Homo sapiens
agcctcagttttcctgtctgtaactgagataaaaattgcttcctcaggactctttggagagttaaatgaaggcagcccagtacttatcacaaagcaagggctccctaagtggatactcagtgtaactgaatctctgtttcaaagaagtgaggtgccttcactgccctcaagaatgtctggggagacgatgaaatccccaaaatgttgtacaaatcatacacatcctgaaggatgtggttataagtctcaggtttttggtattaatgagagaagggcatcagtaattggctggaataatgaaagttgtaatacttaccatttttgagcacccctaatcctcactatgacccagaattttatgataaagaatctgtgattcagagaggttgtttgcccatctcagatctggtcaacctcgaagtccatggttttcccatcatgcagtactgttttggtaggatttgagttgagctttgaagaataagcagacttggataatctggagtctgtcttggataattatgattagacagaccgtcctccaggaaagaaggaacagctgggaccaaggcacggaggtgagaatgacgtgcccaacaataaggagacaccatccatgtggcatgggaagaaataatgagacattataaccccatgtctttagtcctgaaatctgttctgagcatcagtctacccagctgacctcagcatgctaccaatatcatcatatcccttgttatgtgattaccagtctttccatggagaggcaagtttagtcttattccaggaatgtttggcattactggacatccgaagtagctgaatccaaagtgctttgagtggaggacaggcaaagaaaatgaacaaacaaacatatgaaaaaaccaaagtgctttatttaatcacccggtctgcggattgtgttgaatcaaggtgtcagtgattctaggtggttctgtctccccctaaactgagacagagcagatacttcaggaaaacgtggaagttggtccgtacttctacaatcctactggcccagcctgacccccatgtgacagctttgagagttttcatgcagttagagacaaacacaggtcaatgacaacaactacagcatgtgatgtgtgctttatgatctaagcact

SEQ ID NO: 9618 - DNA, 1098 bp, Homo sapiens
agttggcagtaggcttctcagttgcaggcatctgttttctgttccctgtagccagtgccacctagacagagggtcatggctttggatggaagggcagtatgggcaaaacagtttctgcctttcacgttcataaccctatctaggtacccatagtcgagaatgaaggaaacgcttcaagtttctgaagatgtaatcatttatctggacgtgtctttcaaggtaaatggcaaatgactgaatccacaattcttcagttcccctaaacatgtcttcttcattaggagcctgaatccggtagggcacccgtaatgtgctgtccttctaaaatcatttgtttgttctctctccttatctttctcccctcactaccctttccttgcccccaccacaccccctgtattaatatattcccccttgatcacacctggtatcatctacgattaaatattactttaacagctgacaatatctcaagccgtgctttaaggaggtatcattctacttaacagcgtcctgtgcctgctgatcccactgcagtgttttctccgtttaaggcattaccgcaacaaaatcggttttagtgtttcccttgcttctccatgctgaattacagtcacagtcaacggcccacttgtgtgtagttcaagaagcaattaagggctttttttttttttactttgaacaagcaagggagagggggtagagtgaaaaatgatcattattctgatgattcctctgcttagctgaacagttcacagttctttgataccaagagtcacccacatttaaacccatttctgtaactgcctgctgcagccatgcctgctgtcagatccggttgatggcagttcaaggactcacatgccattaggttggagcagcccaatctggctttagaattgtgattaaatacagttgtaacatctgcacagtgatccacggcatgatgatggtatcactgaaaattaaaaagtgcaaactttggagacttcccagggaattttgcagtttctattgtaagccttttgttttattcagtgggatttcttataatctgaatatggtagtcttatctttctatgcatgtctacatgaatt

SEQ ID NO: 9619 - DNA, 1138 bp, Homo sapiens
acacacacacacacacgcacgcacgcacgcgcgtgtatatatgtgtatatatgtaatgatttacatatatatgtatatgtatgtatatatgtgtatatatgtatgtttttaatatatattatatatatacattacaagttttctacaggaaacaacactcagcatattcctaaatactagtagaactctgggcttttacaactgtttggtggagttttgtctgagcaagtttccagatgttttataggtgcctgaaaaggtaggtgaacatcaggggatatccccaagagcaaatatacagaagcaagaaatgttagaaccatctttgcatctgtgtgaatgtgcaggaaacatgcattgaagtgtggctgtaatacagggactgtgtaggagagtggtgggtggggtgggaccaccttggagggtcctgaatgccacattaaaagatttcggttctacagattatgaaggacctaacccagaggtggtggttgagatgctgtattaaaagtaacaccttaaatgtggcaggggattaagtgagatctaaatttgaaaggttggttttcaacataagtgtggggaaagctccctgatgccaaccttgctggtcctgaattgtggcacactgtcaccacctggtggtcacatagccaaattgtagggctaatggatttagccagagtcctggttgtagagaaatttcttcataaaaaaaaaaaaaaaaaaaaaaaaaaaaaaaaaaaaaaaatcctggtcaaattatttgcatcctttaaagagttctaaaggcttataaatatctggataaggatctcaatgtttattattaacctgagtgtctgtaataatgtggacacattctttaagtaactcaaaattgttcaaacctagcagacaaagaacattgtcattttctggactatatgaatatcaggatccatctggaagttgaaaagactcaatagctttgagatttgtaatgaaggaaaaaaaaatcttttaaagtaattcctagcaggttgacatttaagagacttaactgctgagtaccgagtgaagagtgatttttacagaagctctcgtttcagctgattccagggcctgattagatgtcattacaagaagaactggattt

SEQ ID NO: 9620 - DNA, 1194 bp, Homo sapiens
tttctattagaaagacaagcccctgtggcgagctctgaattaggatgttggccattagaagtactgaagcagtgaggcttttagagctgattcagcttctgaaaaactcatctgtgaatctttagggtaaggaaagaaccttcaatttaaagcttataaacagccatggattttacctaaaaacaaatactgagaagacaagaaaacgaaaaatataagtactaacgcaagcagagaataaccaaatcatgggttatccagtatgatatataccacaaaaacattctggtcattgaatcaggcacatctgtttgtgaggatattttattatctttatggttaatgccctgagtgtttatgtgaagcaaaataatgaagacaaattgtgaagaatacactggacaagtaaccaggaggcctcggttctgatcccagcccaccattaattatgtaagtggctctgggcaaatggctttcaccctgagacctcaccttctccttagtacagagaggcactgaactacagcttcctgccagctctgatattctataatcctgtgatttttaaaggaaccaccaaagaatatacttctttattcattccaactttaaaaaaattattattgaagcataatttacttaccattacattcacccatcttaagtatacaattcaataatttttagtaaatttatagagttgtacaaccaccaccacagtctagttcaacatttccatcagccccagaagatccacatgcccgtttgctgttactcctccttcctagccctagtctaagacagccattaatctgttttctctatatatagattttccttttctggacatttcatttaagtggaatcatatactatgtgttcttctgtgtctgcctcctttcacttagcattgtgttttgggggtttgtctatgtcataaaatggatcagtaccttggtcctttatgttgctgaataatcttccattatgtggatgtatcacattttgtttattcattcatcaactgatagactcctttctcttcctttcctacccttggagcgcttcccctcctcttgcctacccccatactgggaaaaaacaggtctctcttagagaaatgcgaggtctttatttcaggccttcccttgcagaagaggccggagctttgtgttttaaacccttccaagtcag

SEQ ID NO: 9621 - DNA, 1102 bp, Homo sapiens
tagcttatgtgatgacccaatacaaacacacagaagtttcacaaaacagtatttactcttactgggtataatgtactttcatgctttttattgtttcattaaaacaataagatgctgtttctgacccactaaactgatttcactgcctactaaacttgcaccccattatttgaaaaatgtggttgtagacctaatcattactgataaccgcacctccagcaaaatctggacaaactcaccagtctgaccgtccccttttctcttttgtcttattgcctctagtacttggttccacctagctttcacctacaagggcttctgacctggtggccctttctttttcattgtccatcatccctttcttgtcctccttacccagctcagattcttgcatataccctcaactaccttgacctttccccgctttgtcttactgtcctcggaaagaaaaccccatccttggttaagcccaccctctgctcactctccttcagcttcaggctgatgatcctgcctagagaaaacacatatctctctgcattgtcttgcttttaatttatggccacaaacctcaaggggactcttgacactttcaggtccactatgtttctatacccacttctcagctgatgacctggcttatttcactgagagaagaagcaattagaagctactttcatcatcttcctatactaaacttactaacctaccagcacacacgtgtgaatgagatcctgtcctctcttggctttcatacatgcagctatctcctttcccttttgcatcatcagtttctcactctgatggatagtccccatcagaaacatgcagtagtacctgtcatctaaaggaaaaaaacagcaggctgggtgtggtccctcacgcgtaatcccagcactttgggaggctgaggtgggcggatcacgaggtctggagttggagaccagcttgaccaacatggtgaaaccccgtctctactaaaaacacaaaaattggctgggcatggtggcgtgtgcctgtagtcccagctactcgggaggctgagacaggagaattgcttgaatccaggaggcagaggttgcagtgagccgagatcgtgtga

SEQ ID NO: 9622 - DNA, 1197 bp, Homo sapiens
actcatccagatgtgtttgacatagtttctgaaatagaccacagcatatgccacttggtttctattttaagataggtatgttgacagaggcattggtccccaaatagaggggcagagggtgtgagatgtgtactcctagggagaggaactgggtgtctttatttggtgatgtgaatttcaacctgaaatacaaatcatggtgttttctgggaagaagactgcagccctgacagggctccagcctgggcgtttcattcagaggctctcacctatacctgttgctggccacagggacccaggggacaatctgacacagaagcctgagggtttttgccttgtaacttcttgttgtatctgaattaagtcaactctaaggctgtggtatccctctggactaatcgattcctggtccaggaggcctgattccaaagttctgaaactccatagggcctgctgagaaccagaggacaaatccctgtaccacctgactgtcaccgaggcagaccgctggggcataccacctctgtttctagtcttggtgttagccaatctcaggggtgtgaattctctatttagtcctcttgactatggactgtgattgtgttacctgcttgcttcgggtctgctcacagactgagttgtgttttctgcttttgagtcaaggttgtcactcactggtttttttcccccagatggcctttgtacataagggcccctgttctggtgtaagggatactaatcttatcatacctgcctcagttatttgaagcttgaatgaatcgagtctcctgtccagattcacttcccttcttgtggatcacttgagatcaggagttcaagaccagcctggccaacgtggtgaaaccctgcctctactaaaaatacaaaaattagccaggagtgatggcaggtacctgtaatcccagctactcaggaggctgaggcaggagaatcacttgaacccaggaggcagaggttgcagtgagccgagatcacgccactgcactccagcctgggtgacagagcaagattctgtccccccgcccccgcccaaaaaaaagattgtctccctaatttaggctcatctgtcctcctttctttttaatacaattttaattttcaaaaagttaaatttcacatgtaaaaattttaaaaagtagaaagaggcatgcagtgaaaagtaactttgctccaatc

SEQ ID NO: 9623 - DNA, 1199 bp, Homo sapiens
gcagcatcgtctccctcaagctttcattgtccacgctgctagaatttacaaggaactgacagaacccccctgttctttaaaggactatgaggcagagtttcaggtgtttctgggaatagaaatagaattcttttaggtagtctttgtatcccaactcaaaagactcaattcaaaggatcctaaaatgaaggaggtataattgggaaatctcagaaatttctctgtatggaagtagggcagtagtatggactgtcacatgtgactaatgaagttataaattagtgggacatgtcaaatcacaaggatgaagtagaatagcagagcgtgtgagactgaagcaatggtttcattgaatgaaatggtcaggtaagtaagaaaccgagcagtggtcctgtaagtaagaaaccgaggcccagagcaggaagggctttgatgggactgcgggggcacatggagagggaccaggattcaaccacagtgcccaaaacctgttcctgtctcacttcaggttgtgagccccactattagctcccctgtgtgccaggagcagctgattgaagcagggaagctggtggaccgctcggtggagaactgtgtccgtgcctgccaggcggccactaccgatagtgagctcctgaagcaggtcagcgcagcggccagcgtggtcagccaggccctccatgatctcctgcagcatgtgcggcagtttgccagccgaggcgagcccatcggccgctacgaccaggctactgacaccatcatgtgtgtcaccgagagcatcttcagctccatgggtgacgctggtaaggcactgtgctgtgggtgggtggatgggtggcttttgatgttcctgatggtggtgctaacccatagggaaggtgaaggctgcctggatgactggcaagggcaagttctcttcagtctcaaagacttccccactgaagctcagaaaaagatataagactcttccatagtcatgcttacagatttctacagagttcactgggtttttgttataatggttagattttgttattttgttagatttacagtgaatcccctttgttctgcgaatgcacgtgttgggtacggtatggcaaagttggagcagccacagaaggaaacaagatcaaggcttggaatttaagaagtttattatacttgcatgtcccctggagggctcaccacatgccgcacag

SEQ ID NO: 9624 - DNA, 1237 bp, Homo sapiens
cttaactccctagaacttttcacaaatggttatcagtctgctagatgacatttaaaagttattagcaaaggccactaatataattggtggctattagtttggaagaacgtgatttgaagtttgagagcatctgccttttagtttacaaagctaaaacttagctttcatcttaacagagacaaaatagggtagagttttagagaatggaccctggagtcggattgccttggtgtggatcctgtctctgccacttaggaaaccttgagcccctgtagatagcttacatttttagatccacagtgtctagcactgagcaggtgtttgatacatttaaatgaatgaatggatgtatatgttggtggtcaaacctattaataaaatgggctcagatgactcagagccttttaatcgtgatgactcaaatgcatctctgaagagtctgtctcccttccacaataccttccttttatccctcccctgcaaagcagaatgtctcatggggtgtgccgtctgttccccacagctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcaggtgggtgtggaggtggttgtctggagttgaccttagcctctcctctcggatggataatccatccttgagactgactgaacaaataggaaaaggaacctggaaacaggcaggccatggttgcattctttttgctgcttaggaagctcatgccctcatgggaatggcattcccaaagatgctatcagcttatgcatgaggtgctgttagtaataaagaataacttctcccacgatcctccagcagaattcatagtcttactatttggagggagggtaggaggagggagaatgtttaacaaagattagaacagctcttcaaatgtgggataatacaataaaaatatatatgtatttgaggtttaatggaccattcagatggtctgtgtctaatacagagtgtcaagtgattaaaaattacctccttcagatgaacagataaaccccttgtttagaacaagggagcttgactgatctggtgtcagcttgcagagctgtgttttttgtttttttttttttt

SEQ ID NO: 9625 - DNA, 1128 bp, Homo sapiens
ggatacagctggggaagggggtgttctagttggtaaacataccaattttgcaagaatctgaacacttcaaaatatgcttaatacggaaaccacattttgaacctctaattaccctctagagctattttgaagaataaatgaaattaaacacattacctgcttagaagaggccttgacacacaataggggctcagtaaatgcttgttgaatgaataacagaattatcccacaaagttcctctaattaacattcttaccaggtggctggaggagcagataagctataaaccaggaaagatatgtatcaaggagggtatcacgctaggacctcaagatacagccttgctaggtagagactgggcattttacagtctctcaaaagggaagcaaaatcaaccaaattccatacttcaccaaacacagactcctaataggagtggaattttcctagccaggctcccataggacataggagaaattttccacgtagggaaggcctcgatggcagagtccatcacgcttctccttccccatcctgggcttgcctctgcagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtaaggagcagccctcagtttagagtcacaagaacctgcgctggctctcagtgatccgctgtaatcaaggacaaaagcaggaaactcagccaaaactaacccagctgactcagctgtctcatcccgatcttccccactgcccaggttctcccaaaaatggggtgcatcagggagctggggtgatcataggcccagagaatttgagggcttagagggactatcccatgaaggtcaggccctggcactcccccttcttgcagggcttccccgtaggcagattgtatcaaagtccccatcagcagccaggagcccctggtcaggggaggcctggagccagagccctttcctgcaacctctgttgacaccatctttcttctcaaggaggctgctgagggctgagggctgagtcaggaggagtgaaaatccctt

SEQ ID NO: 9626 - DNA, 1378 bp, Homo sapiens
aggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcc

SEQ ID NO: 9627 - DNA, 1119 bp, Homo sapiens
acaaatttgattttgtcagttatctcaccaacttgtctcacgttagtgtctcttgtattcttccactgcagtaaggaggtagatgcacagatcagccatcaaattgatggagttcttaggtttactttgttttcctggcagcccccacctttttagtacatgtctcatcctactgctgtttttgagattgtgaatgtgtattttatccctccttccacattttggtctggctgccggttcacctaggtcagacttccaattgagactgcccaatcacagctaaccattctgagtcaaagcagaagcctctgatctcctctctgctggcactcctaatagagagttgcttctctctggtctaccagaaagaggatcatattgtttgtagacaaaacccttagggcctgatgggatctgatctctacccccatgcccttctgttacacaaagcttgcaagacccatggtgtgtgtgttgtgtcttcctgctgcaggtggcccgtaagctggtcatcattgagagcgacctggaacgtgcagaggagcgggctgagctctcagaagggtaagcgggcccggcgccaggaggccacgaatggggtgctgcagagcagtgactaaacagcatgaccttctggcagctgcacattacctgtttcagctccgggctccttttgtgctcatttgatgtggatgagccacgagtatggaacatggaggactcgtgtggggtgtcttatgtatgaatgcgtgtatcactgcatgccttacctgcacactgattttgtgaatggccttgtgcatttcctgtgtccactaacagccaagtccgacagctggaagaacaattaagaataatggatcagaccttgaaagcattaatggctgcagaggataaggtactgatggctcgtgtggtttttaggtttaactgcaacccagacatctttcagcttccaatgcctcctggttcgtttggtataacgactgcaccttcacttcaccctctgctatttatatcttgccttaagtgctttcccttggtcctttatgctcctttgttttcccttcataaatgctctttgggcagccaaaaaaggagccaaattatcgcacttca

SEQ ID NO: 9628 - DNA, 1290 bp, Homo sapiens
cctgactgctctgtgagaatccgtgccatggctcctttgggtcaaagatgccctcccctccgtcttaggttcttgtctagaaatgagtaatgtcttacaagcatgcctagttctaatcatctcatcctgtgtttgtgattgatgtttgcctgcctaaatgtacaaaccaccattgtgtccaaagcacagctattcatgacttaattttctaatctcaccacagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaatttggtggtcctgtcatttgtatgttcttaatttgtgaacttttgaacgtgtgactgacctgccttcccccacaaataggttctcaaaacaatatcccacagtccaggggaaactgggtttcatgtgttaccttctcagaaacactaaaggcagcattattttggtctgttaaagttataaccaagcaggagagaccctttccaaatgttgttttcaatgttattggtgtatgcctgcaca

SEQ ID NO: 9629 - DNA, 1406 bp, Homo sapiens
agtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaatgctaatggctctctgaaatggactgcacattttaaaaatatttctgcaaatttgggccagatgcagtggctcacgcctgtggtcccagcactttgg

SEQ ID NO: 9630 - DNA, 1143 bp, Homo sapiens
ggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactca

SEQ ID NO: 9631 - DNA, 1160 bp, Homo sapiens
tagaagcacttaaattctgcagttgaagagacagattcctctcctagattttgagaggtgagaattataatgcaataaaatttatgtagttctgttctccagaagtctcgtagtgctctacaacctaaatcttgatggtcatgtgccaatcaaaagacctgacaaactcaaaaattagagattaatgttcttaaacaacaaactaaaataggttttggaaaaataaatggaaaaatttctagcctctgcaggtggactgttgtcaattgcaaacaagcttaaatttagaaatttgacatagttttggagaaatgtgatgaagtagattaaacagaaaattcagaatagcctgaatttggatctccattttacatagctgattggttaatattcttttatcatgtaatcccaggtgttgattgccaaatttattgattttttggtaattttagactgcttgtctttagggaaatcgtaaagtgaatattcttcccactaggaaacatagtttatcaatagcatatatgggttataaattctgctggtcttcatgacaccatcccatttaagttatttttcaaatttttgtgattgttattagaaatttgtgacatatgtagtgaaatttttcctcttgtgctgtagaccaaaatgtctagttaaaatccaaaactagatgagggaaatatttaatttcctgttagctagtttatacaaaactgttaacctcttcgactaatatatttaggtatcaggcaaaacattgctaatcttaatatcagtattcctacttcttagtttatctctgatatgcaccggaactatttaaacatctagtacatttagaaactacagcattgtagttaaatggactatgtaaagatgatgagttctcaaaaatgtgcaagtggtaatgtgcttattcagtattattactgtagcaatgaattactgttgtttttcatggtttagtattataaatatatatgataagaataggtgattaagattaagtattgaacctatatgataccttagagtttgccttttatttgtttatttatttatttatttatttatttacttattggacagagtctcactctgtcacccaggctgcagtggagtggggtgatctcggctcactgcaacctctgcct

SEQ ID NO: 9632 - DNA, 1307 bp, Homo sapiens
caggtctttttgtgatttctgaggttcttttttcctttggtcttttgcctttacagggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaattactctctttgttggtttttttggttttggggcatacttgtttgcggggaggtaagatgggagtaaagaccaaatacatgtaatgtttaaaaaaaatgctgtgactcactgacatggtataggtgttaccagtgaggtaaagccatggcgtctgcctccttttgaatcagtatctcattcccccttagttgtaccactggaagtcacgacatgtccattatagacttacttactgcttgtgtttggcatctgagtctgaggtgtgaccctctgggatttacttggatcatcacccgcacttcagtttatcactggggggtgtgcttccacaggaggaaatttagaatcttcgctgctctgggttttaacacctctctctggcctatcctgattgataggacaagttgaaaatactgttggagtaagtaagtggagttttcgtt

SEQ ID NO: 9633 - DNA, 1175 bp, Homo sapiens
gtcattaagactcatctgctagatttggaatggccttgttgcagcttagtttttagcagtcggagctgtgaggactgttatgataaagaaaatcagaatgtattttattattgggggctgggcgtggtggctcacacctgtaatcccagcactttgggaggccaaggtgggtggattgcctgagctcaggagttcaagatcagcctggccaagatggtgaaaccccatctctactaaaaatacaaaaattagccaggtgtggtggcgggcacctgtaatctcagccacttgggaggctgaggcagaaaattgcttgaaccagggaggcagagcttgcagtgagctgagattgtgccactgcactccagcctggacaacagagcaagactccatctcaaaaaaaaaaaaaaagaatgtgttttattgatgctgatgcatggtacagttattaacttatttatgtctgccaccatctaagaaaaatttcatattgacttcctctcttcctctttctaattgaatgtctgtatatttgtgatttattcccagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgaggaatgaaatattcatgctcctgcagcgtttcttttttagcagtaccccatggcactgtctgcttgccagttcccaactgtatccagcatcgttgtgaaaccatcaagccttctgccacacaaagcattctttgtgctactagcactggaagtattttcatagcaggcatttgttctgctgacatcagtatgaaccacgtcctctctgcactcccaaaagcagaatacatattacttatgcaagcaaaaatttataattttagcagcaactaagtttttttttgagatggagtcttgctctgtcacctaggctggagtgcagtggtgtgatctcagctcactgcagcctccgcctcccaggttcaaatgactgctgcctcagcctcccaagtagctgggactacaggcatgcactaccattcctggctaattttttctgtttttagtagaaacggggtttcgccatgttggccaggctggtct

SEQ ID NO: 9634 - DNA, 1185 bp, Homo sapiens
gcatggtggcatgtgcctgtggtccaagctactcaggaggctgaggtaggaggatcatttaaacccgacaggttgaggctgcagtgagccgaggtcgcaccactgcactgtactccagtctgggcgacagagcgagaccctgtctcaaaaaagaacataagaaacttgagggcctgaactgtgtcagtcagaccctatcctttcaaagatgtggatattggagaagcctcttattttgaaacaagttaccgagtttagatacaactttttaaaaaatttttatgaataaagagcctgtgatgttttgcagagaaacagcttcacactttttatttattcagaacgtggtgtacctttccagaatagcagctttagcctcagttgagttatatgtgtcattgccattccaccataataagctaaatgactgatcagaaaatataaaagcactgtgttgtgtggtgcataacatttccacatgtttttgttttgtttttttcagatcgcctgataggcttgccagaggggcgtgctcgcaatcacaatcgaccgcaacaaatccctgtcctggctggagtaatcatagaagatgtggcagttggagctgaacacacacttgctttggcatcaaatggagatgtgtatgcctgggggagcaattcagaagggcaggtaaatatttatattgcttgctgctttctcatattctagaaatctcacagtgttcctcagttggggaaagagataagctaggaaattcataatctactgcaatactccaagcacatcactttgctatgggactgattattttgtaagtctagttatgtctttctctctcgactgcggccaaagaagtattataccatggtttaaaacaattctggtagtacagcaaagtgattaaggggattggctgagtatttatgtgtgtgtcctcatacactgttaagtgcctggcatgtagtaagctgcagtatgtaaggatttgctactgtcaacattatcatcattactacagcaagatgtgagattaggtcctgggaacatcagttgatatgggaaaaagaatgaaacaataatatttttatattttataatatgatggcatacaaagtatctttaggtttttgcaggaagtcttgtcactcccattatttataggattaaactgagcctctgaga

SEQ ID NO: 9635 - DNA, 1687 bp, Homo sapiens
tacaaagtaaacttttttatgaaatgaagtcctcactgaaataagttataagtaaccatttataaactagatttattatacaaattttctgaatagcttacatcaaactacatctgaccaacctcctgtttttataagtaaaggtacacagccacacccatttgtttagttgtatcagtggctgcttttgcactatgatggcagggttgagtggttgcagctgagactgtgtgccctgcagagtctaaaatatttcctgtctggccccttacagaaagtttgctaactcctggcatacattatatattagtgaatattcttatttgaaagcatctcattgcttctgcatttagtatcacatctccccattttctcataatagactcgtttttctctgtgtttgtaatgatttctctagtttgtgtaaattattctctgtattgtgtacatgatgcaccttattttgtctacattattttccgtaccttcctcccgtctttccctcacttgcttcttcctgtgtcattctgatctttattaaagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaaggtatgttatctgattttttttttttttgcttttgtgctgttgagattattttcataattgtcagaagtgatacattctgtaagtgatttgtaaaaaaaaaaaaattttttttttggtcaaagcaattttcacatcattttttcttgaaaacagttcttttttattatttttctattagtaatcttctgtctataattttgctattttaaacctataccagtgttagaacacagcaattattactacattttgtaaaacaaaatttaacttataccaaaaaaagtatttattgatctgactcaaaatacatagtattctggcaagcatggtggctcatgcctgtaatcccagcactttgggaggccgag

SEQ ID NO: 9636 - DNA, 1173 bp, Homo sapiens
ctagcagtgtcttaagtgcctagttcctttttgttcataaatgatgatctggtttaatactgcagagcattttaagctaagcattttgagaacagcttctgcctttctttttcttgtggcagcgtgttgctaaagcgcttacagagacactggtacatcaaacagggctttccctttattttcttacattgctctaatttttgtttgtttgttgtttttaccaaagcattttgctcagattcacttaatgcatgcgcgtattcaaacatgagtatccatttttcaccagttggttatggtagcagcactcagccttatctagtttcagaatgtatgctctacttgattgccattgatatatgtttattctgtttgtatataggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaagtaagtctttgatatttactccttatgagagctctggaaacttaaaactgaaccattgaatgtatagttctagggaaaacctttccttttcttctattccttgccttcccctttcctgtacctgagcttttaaacataacattcttcactagaacagcacattattttgtttgaactagacaaaagtgcattttaaaattgtcatctctcagaacaatatactcagaagtcttcacatgtctcctacaaactagggtgagactagttgatgacaataggtcatcagagccttttttttttttttttttggagacggagtttcgctctcgttgcccaggctgtagtgcaatggtgagatcttgactcactggaacctctgcctcctgggttcaagtgattctcctgcctcagcctccagagtagcagagattataggcatgcgccaccatgcttggctaatttttttgtattattaggagagacaaagtttcaccatgttggccaggctggtctcgagcttct

SEQ ID NO: 9637 - DNA, 1158 bp, Homo sapiens
tcccaccctgctcctcctaacaataatataagctctgttagatcagggatttagttttgttcactgctatatccacagcgcttggaacagtaagtgggatctaatgaggtgcatttgttaagtaacagtttagaaagatgataaaattcaggtgttggatgactaaagctataaaaattacctctgaactgttttctgagcccttttaaatgtcaatgcatcatttttattttcagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatgggtaaagtttgaaatcaattaatttctatgtttttctgcaagctgtgagagctagctctaaattggtttatgtgagaaaaaaatgtgccttggttattgcatatgttcaatacatgttgagtagttcttttcctagcagaaaaaaaaaaaggaaaagatttgagatttacttaacctcacatttaccaagtgtgatattggttctaagaaactttagttggctgcataaatattaataacaaattgaatgattcaaatcatatgaatgattattcctctctttgtgctgattgggccacatttgaattatcctgtttaatttggggtgccataatttatgagggacattaagcaataccttggattgataaagtccaaaaattatgtcatagaaggactagaaagtatcaaaaatattcagcttagagaagtgaaaaccaaggagggggttgtgtgtgtgtgtgtgtgtgtgtgtgtgtgtgtgtgtgtgtcacataatagctgccttaaaaatacttaaagagcttctctgtaagagaggaaataaatgttttccttgttccggaggacacaactaggacgaaagggtaacaatcaaa

SEQ ID NO: 9638 - DNA, 1196 bp, Homo sapiens
tcacacccatcctccagtctctctaggctgagctcaggagacccagcagccacagaccacccagccaagtggccttgattatatggcagccacaaagggaactagatgtaattttctttattataatttggcctctcctgatgtctggtttcccttagatgccctgctgctttccttcctccaagcagttggtctggcctcgtttcagatccctcccatcccccagcccctggatggatcagcaggcttgctttcaccacccacctccctggcttgtagtcccgtggtccaggtgaatcaacccaggttgcccagcacagccccattcctggcgtctcatgatcctcctgccctggacctctttctcttttttttctccagaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgc

SEQ ID NO: 9639 - DNA, 1214 bp, Homo sapiens
tggcgatctccattatgtcaccactgtacacattagacacgggaaaacttatgttctaagttgtctttggaggccattagcagaaatattcgttcaaaggtgggaagctgtgctggactgagtcccttaggagacgagaaagccaaaaagccctccccatgccatacctgactacctcactggcttcccatgacatcccttttcacagcaactgaaacctacttcctgtccgatcaggaagtaagaaagacgttggctgtcagcggatcccgcggagaaataattgtaaagagtctccgtgctggagaactcaagatctcctttcccctaccccttcaggattcatctttaacttatcacggatactgagtgagtcagtcgcggttaacagaccgttacatccacttctaccaggcggacactacaagtcccagaatacaattcgctgccttccgaagaaaatagctcacgcatcccagcatgcaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatggtaattaattttacccagcacagcatttggcgttataggtgcaggccggagctgaggggtgcggggatgatggcctcacctgagggctgggaggggagacctttttttttgtttgtttgtttgtttgtttttggccagatcttgtccggggcgtagcaggcgctttcttcggggtcctaagtcacgtggggggtgtgggtctttctgggaactgggctcttcgtaaacctggggcaagccgaacccagaggtcttaaaagcttcattctccacgtgtggcctacgtcttagtaaccattccaagacttgtggggagaccacaagtctagggtgcctggttaggaagcaaagctggc

SEQ ID NO: 9640 - DNA, 1310 bp, Homo sapiens
ttctttggcctgtttgttatttaacaactgggctttggttctccagggatattggagctgcttccttcaggtaggcctaacccagtgaaactcaggacagctggtgcctctccctcctgctcctgtgaccaggccacattctctttactctctgaatacagttaactgtggtgtaagtgactgggttgcagagccctcagttcccagatatgcagtgggcggcattgctaagacatgccatgcagtgtcagctgatttgtcccttttccttgtgagatcagagaggcctctgctgtcttttcctccttccagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgtaagcttctgtttccttttctcctccttcccttgatttgatttgtttttcctttgctggtccccttcccaagacagtttcatcccattatagcttgtaaataggtgtcactttttctacttttaagaggaaaggtatcctgtaaaccaagcaatctattcacctgttagctagttatcactgaatcattttgagccccacagccaagattcctagatggcatttggagaaaagaccactcttgaatttccgaataggttgccctttattgttgaggccagacagtgtcttctgtggtcctttcttgaagcaaggttgcttacagacctactctcttggtcccctggagcagtgacttcctcagtcctttggtctttgcctccttaacagtaactggtggctttgccctggttaagagctcttgctgacttccacttgtccttccagtatgggcagtcaggtaactacatggaactggcttggcattgcatggaggagtgcggccaggggactgagagagcttgtcaccagagccttcctgtgctgtgtcaccccacactggtaacattccagcctgcccctcgtcaagcacctcactctttctcctggtgatcaagcagtgtggtttccccgtgagcactcctagtgattaaggttaaggaattttgacagtagtattagctgtcgcatggcctccctaagacagaggaaagaaccaagaggaagcctggcacctacactctaagggcctaagtctgtccttgatttcgcttgggatcaggatgtgtgagc

SEQ ID NO: 9641 - DNA, 1204 bp, Homo sapiens
tcaggaggctgaggcaggagaatcgcttgaaaccaggaggtggaggttgcagtgcagtgagccaagatcgcgccattgcactccagcctgagtgacaagagtgaaactccgtctaaaaagaaaatattcggggaacttttgcagggcagtgagggagccgctggaacccggctgggcggctggccccaggcacagatccttgatccaggctgctgcttggggcctattaagcaagtccgggtgggcgtggttagtcaggccagcagcttccttccctggaaatgctgattgtggtcaaggaactggaaacaaggaaaactagcaaatagattttggggagcttcttggaggccttggtagcctagagcaggtgagtgtgtggttgggaaaaagcaatgtggccctatggtggttttaggtgttgatttaaagatttgttaagctaaccttgtgcattatttgggtgtcagtttaaaggctgggtccttagggtggacttccctgacatatttcccaggctaagctaggcctctggtttcatgttatagtaccctgctgctttcccagtagtctgcatacttgtatctatttgtaattgtaaatgtaatgttggccttttccattagatgacaagttccatgaaaatgggaccatgagtttcatccactgtattcttagctcctggcacatggcaggcactcagggaaagtatgtagccttatgaactgactgatctgagggaggcacttctgtaagccatagtattggtcactggcatgaggccacctactggatccctgccatccagccctgggagtagcatgaagcagcatggcactggccttctggaagcttggagaggagtcttacccaagctttgctcctagacattaaacttcccagctgggcactaacatgtggctgcagaacctgcccttgctcagtctgtccctggtgcagctgctgggagagcctgcctcgaggcagagccagcagagctcttgaagagctggttgtgctcctcctcaaccccacccccacaggctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgaggtgagtccactgaggca

SEQ ID NO: 9642 - DNA, 1376 bp, Homo sapiens
agggctactactgggcaatcctcaccggggattcaacacagaccccagggcaggagctccatgtgtccatccctttcccaaaaggacccaacccacagatgcagcccagtgctcctgtccagaataaaccctgtacctccatgcctccaaggttctaaattcttccagccccctcagagcccagccaggaaggctgcacaactgccagagcctccctcccctccttcactcagtgacgtgctggtcccacccctgaggtatacagagtgcagctgaacgcaatgtccctgagaagccacatgccctggtcaccctcttcctcctcctcacccttggcccaacctgggtcttacttcaaaggaacaaaattcctgtaccccctcgtcaaatctgcattctccctgctctggccaggagtctgttagaattttggtgcctccagttttgtgtgctgttgatcacttgtgggtcttagccctcctgagccatacgctggggcctttctcctgagcggtggacctcctgatccaccatgccctcctgcttccacctttcttttccaggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatatataatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgattttttttttttttttttttttttggtagagacaggtctcactatgttgcgctggctggtctcaaacttccagacccaagcatcctcctgccttggcctcctaaagtattgggattacaggcatgagcctctgcacccagctgacttcttcctttattatttatttattttgagacggagtttcactcttgttgcccaggct

SEQ ID NO: 9643 - DNA, 1124 bp, Homo sapiens
aattctaacagactcctggccagagcagggagaatgcagatttgacgagggggtacaggaattttgttcctttgaagtaagacccaggttgggccaagggtgaggaggaggaagagggtgaccagggcatgtggcttctcagggacattgcgttcagctgcactctgtatacctcaggggtgggaccagcacgtcactgagtgaaggaggggagggaggctctggcagttgtgcagccttcctggctgggctctgagggggctggaagaatttagaaccttggaggcatggaggtacagggtttattctggacaggagcactgggctgcatctgtgggttgggtccttttgggaaagggatggacacatggagctcctgccctggggtctgtgttgaatccccggtgaggattgcccagtagtagcccttgcttccacaactcaccatgccctctagaactttgccaaacaccacatgcttgccatctagccaggctgtcttgactgtcgtgatgaagaactgggagccgttggtgtctttgcctgcgttggccatgctcacccagccaggcccgtagtgcttcagtttgaagttctcatcggggaagcgctcaccgtagatgctctttcctgggaaaaaagacagagcaggtcaggggcgctggattgcgccaaaccaagcagacattcggggccaggactgagggggcttaacctgtcctctgtgccaggctaggctggagtggactacaaggacataaaagcagcgtccttcctatcttctggcctcagagccaagccatgctgactgaggccaagtggggcatcaggccaggctgatgtggtgaacagctcacagaaggattactttgagaagatagttttgtggcttttaaataaggcgcatgttatcagctccccttagctatggcccaggcctgccacggagggactttggtggagggaagtgccgtgcaggatgcaggggagtcaacagggtcggaactctccagaaaaggaggactgctgtggctgaccagcctgttttcctatgagcacaaaagacacaggcatagctgcagaggagaaagcagccagagatgtgtggggaggggcagaaaaga

SEQ ID NO: 9644 - DNA, 1195 bp, Homo sapiens
aaaacaatacttcctgccagcagagatgtgctaaagaaaaaaaaatcattaaaacaacacaacaagacagagctattgggtgaatatagaacattgtactcaagttttaaagaattagtttcatacagttactactatttgcagatatagttactttgtggaatccaaaatttctgtaatgcgagaggtaacaaccttcaaagtagccctgaaaatctcaacaaattcaaagaatatgtattctatagaccaaaccttcgatgacagtgcaaactaaattaggactcagttttttaaaaaaatgacctttaaaaatgtttggaaatttaaaagaacacatctaaataactcttgaggttacaaaagaaataatgatagaggtttaccaatgcataacactgaatgttaattaaaaaaacaacatcaaaattgatggatgcaacttagtggttcttgggcatagcatatagtcaagtttcataaatactctgtgagagtttgaaaagaccattctctagttgagggcagtggtattaatagaggaaaagagcctcagaaattgagaactgtcagtcactcctcttgatttaatattcgtatttaaggccttgtgcaatttgtcctctgacagttgtcagtgggcactactgctcctcctgtttcttttgctttaatcttaattacataattaaagttctcttattagacactagtggttctaaaatgttagcatgtattggaattttctggagggtttgttaaaacacagattgctggctgggctcatgtctgtaatcccagcactttgggaggccgaggcgggtggatcacctgaggtcaggagtttgagaccagctgggccaacatggcgaatccctgtctctactaaaaatacagaaattagccgggcgtggtggtgggtgcctgtaatcccagctacttgggaggctgaggcaggagaatcgcttgaacctgggaggcagaggttgcagtgagcggagattgtgccactgcactcccccttgggcgagagagtgagactctacctcaaaacaacaacaacaataacaacaaaaaacaaaaaaacacagattgctggtcctcaccccctgaatttctgattcagctcatctggggtagggcctccaaatttccattttcagcagatttgcagatgatgttcatgctggtgacc

SEQ ID NO: 9645 - DNA, 1191 bp, Homo sapiens
caactcgactaactgcaacctccaccttctgtttttctattgtattatctgtccttttcttagtggtttctgattaagtcaactttatatttatttttcctattttattgatggcccatatttccaaatctgtgaatatcatctgcttttagaggcattcttgtttcttatgatctccaatttagctgtgcttaaagatgtcatataaacagatttaactgctacatttaccctccactagctatagtaatgggctgaaagctactagcagaaaagacaaggtaattatcagctagtttttctagagtataacctttcctcagaaccttgattataactaatttgtatttcttcctttcactgccttctttcttggttcttggatagtatataagttgttactgaacagaacggagcattttctcccttgactttttacattgtcattaattatttgatgttattttgatgtctttgtacgataggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtaaattatttcttttctattttattttactgtgctttgtgttaatacgcagagccagtcagatctcaagtaatttctctttttttgtttttttttggttgagacggagtctcactttgtcgcccaggctggagtgcagtggcacgatctcggctcgctgcaggctctgcctcccgggttcatgccattctcctgcctcagcctcccgagcagctggaactacaggtgcctgccaccacgcccagctaatttttttgtatttttattagagacgggattttacagtgttagccaggatggtctcgatctcctgaccttgtgatccgcccacctcggcctctcaaagttctgggattacaggcgtcagccaccgtgcctggctttctctttttcttagtaaatttcttccctaaaatatccagtgaactcgagtgtcagggatatgattagttagaaacccaaggttaggccaggcacagtggcacacgcctgt

SEQ ID NO: 9646 - DNA, 1155 bp, Homo sapiens
ccttgaattctatgctggagttgtctggctctcttaataccaaaataaaactagaagacaggaggtgaagagcctagggagggaggaaaaaagtttatttgaacaacagcctgagcatagaggtgtctggattgatttttttctcctggatagactgtgtgcatgccgaaagaaaaacatcaggagctgtgacagatcaggttatgcaaccattttgtgtgctgagataagacagtttacaagaacttcacaagtttacaagaacccacctcagcatccaaaatatgcaactggagcctcattagtaaatggcagaataacatggaaacttctccttttcatggttagactgtgaaagtctgtctttagttcatatggtggtggtggtataaggtctctcttttatttgtggagacaccagggaggaagtgtgggagaaacttgggggtagatggccttcagttgctcagtgatgaatagcacaatttaaagcctagtggaaattcttagcagcctgagtgcaaacttgcccaggaatagccttttaggactttacaacactttgctctgactgtgtaactctgggacagtgtggcctaaaggaagtttcacatttctgagctggttttttgttgcagtctaaatatctgtacccacttttgaatagttgggttcaattgctgtcaatttgtatagtgcctaaaggtttcagcttttttgtttttgtttttgtttttgtttttccaggcaggactcagtctcatttatataaagtcagagtagggggatatatgaaactggagactttctctgacggggtttaggaagccttggctttattgcttctcggccttttggctaagatcaaatgtaggaagccttggctttgcagttagatgtttggaatagagtaagggtttttgtttgtttcttgctatagctaatctggaaaaagaaaactaggtatcccctcttttaagtcagaagtttacataaattcattttttcctaggaagtaagtgtgaaaaatttagacttcaaagcccatttatgtggatttcatttaatttagtaaattttaaaaatgcacctagccaagatcaagacagcatgggagttattctcaaaaagtcagctcaaaaagacgagtaaaca

SEQ ID NO: 9647 - DNA, 1878 bp, Homo sapiens
tcattcttaaccataagacttttccttcccaatagtaggaggaatctatactatttgtactagagatagaccctgttagagagtttttaaagcttttgctagatcatgttctgcgtctctgataatgtaagaaaaagcaaggagaaatgggggtataagtaaagttgtgctagagcttgcatctgtgatatgccaggacctgtattgattgaggaagggttgccagctgacagtggtagtagaaataggtctcttaggagtgggaaattaactctagaggactcctagttaagacttaccatggaatctctgggcaattggaaatactgtactttcccctagggagatggagtgggaattgatttttccttaggtccaatgtaacttggttagaaatacaattgaacctgtttgtcatgtctgttgtgatatgatagccccataggaagggtctgtttttgtgtgggagtttatttcaggcgtctcttgcctgtattgtttcttttaacagctttttaaattttctttttccagcaatgatgttgtccactgggcatgtactgaccaatgtggcaggtctgagaacatagctgaagctgaaaataggaaagctgggggcaaggaagagccttgaatcttgaggtgggacgttgactctaagatgtccttgagcagtggagcctccggagggaaaggagtggatgcaaacccggttgagacatacgacagtggggatgaatgggacattggagtagggaatctcatcattgacctggacgccgatctggaaaaggaccagcagaaactggaaatgtcaggctcaaaggaggtggggataccggctcccaatgctgtggccacactaccagacaacatcaagtttgtgaccccagtgccaggtcctcaagggaaggaaggcaaatcaaaatccaaaaggagtaagagtggcaaagacactagcaaacccactccagggacttccctgttcactccaagtgagggggcagctagcaagaaagaggtgcaggggcgctcaggagatggtgccaatgctggaggcctggttgctgctattgctcccaagggctcagagaaggcggctaaggcatcccgcagtgtagccggttccaaaaaggagaaggagaacagctcatctaagagcaagaaggagagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaaggtaagaggtggccagatatggctgcccactgactgccagtcagaactgccctggactaactgccaaatactatgtgtactctgtgggaggctcattagtgtgtgggtaatgaccaattacaaggtcagagcagctggtaatgataatgtggttttcttccaaattagaggattcccctacagactcatttacagcaggcctggacattgtggaacaggatatttgttgttgggggcagctactttgtagaatgaactttctgtagtctgagttgagaccttcccaccttgtctttgcccacctcagacacttgttggtagagattggcatcagacctttatttgtttcccagcttgactggcatttcatcatcagactcataatagttgataaacaatacgcctttggtgataatgtagattgagtacggttcttgatgggataaatggtgctgttgggtctctggtaga

SEQ ID NO: 9648 - DNA, 1211 bp, Homo sapiens
gaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagt

SEQ ID NO: 9649 - DNA, 3984 bp, Homo sapiens
gcctggttatctgtccatgtttcccttgcagacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccctctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagc

SEQ ID NO: 9650 - DNA, 1789 bp, Homo sapiens
tccggctccctgaagggccgtagttcctccctctgccccgggtctcaagagcttagccgagcccagagcaggcctggctttagctctagtcccacgcctctgctcacggccgcctctctccctccctccaggtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctcactgggacctggcaaggcctgacctcccgcccaaacttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaaccaaaatgactgctctcggcctttgcttcccccttccgtggacgcagactgccattgggaaggcagagccagagagatgtggagtcgggggaaggaagtgaagtgggcctggcccgctggcagctggcttgtgactgtaaaggtggtgggggaggaccttggagctcacttagcctctcctgcctccctggtttgtaagctggggaaacaaagtccagggtaagtgacttgcctaagggcctggcagttgtggctttacttcctcagtttccaggctgtcagggtagggagagactccctacaccaagagcaggcccccaggtgggaccttcctgggggaaggcggtgatatactcggcttaaccatttacggcctgtggtctttttgagtctcgctctggtaaaagaggactgaggtttgggctgttgggctctgccaggtggtgtctgtccttggcgtgcctcttgtgaggctgtgctggagggaaggctaggacctggaatcttgcccagaaggggttaacctcatccaccctgtagtctatgggctgcaactc

SEQ ID NO: 9651 - DNA, 1050 bp, Homo sapiens
atttttagtagagatggggtttcaccatattggccatgatggtctggatctcttgaccttgtgatctgcccgcctcggcctcccaaagtgctgggattacagacgtgagccatgatgcccagctaacagtaagaatctttaaatatatgtggttatataaagaatctttgagattcagtgtagccttttcagtttgcagatgagaaaacttaaaaggtaaggtctgtgctctcgggttactagttagtggagcaaatgggaatttctgcctgaagtgatgagtgctgccgcgtgatgcccaccctatgtgctagaccgcgtgattcagaacgcagggcggtggacgtttggcagtggcggaggtcagggtgggttgatgttgacagggagaagggtgtgagaatgactcaggggaacgcgggggctgatgaggtggcagcgctgggctagcacaacatacgcttctgaccttccacggtaacagccacctctctccgcaggggtatgaagggtccctgatcaagctcactgcaagacaggtaatttctctcctagggttttcttcctcccagcccagaccggctgctgagcttcaaacaagggcccgttaacccttccctaatctagaggcatctggcggtacagacttgcgctccctgttgtcctgtttctgacagagcagcctctgtaggtcccactgtctcttcactggccatctgagcccagccagctcctggtcctccctgtctgtttcttaggaatctgggagccccgctggctgaggacagtaaagcagttagctgagctctagctttttttttttttgagatggagttttgctcttgttgcccaggctggagtgcaatggcacgattgagctctagcttttaatacaaggaggccagggcccgctagcctttgggggctatttggggtctagactgatccttgggaaaatgaagttggagcagttttcaacctattgctccttgatagaaccggagtcttcccatgcccttgatacattggtgtcccctttcttgctgggga

SEQ ID NO: 9652 - DNA, 1245 bp, Homo sapiens
gggattgggcaggccttggggtggtctgcccagaactggacaatggtactgtgagtgtaaacaggggtgtgagagtccaaaggcagatcttccccaaggctaagcccagcctctgtgtgcgggctagaggggagagggagtgtgctggaaggatggttctgaaaataaatcttcggagtcgcgtagggttttcagacccgacaccacgcgccgccgggtggctgccgcagcggcggcctcctcccaccacgcccagccgtccactggatttggtatgctcagccaccaccataaacctccttcctctagcaggcaattggtacagcccaagctcctggagtagagacgcaaagaaagacacgcccattgttacgcccctacctctgagtggctggagaatttaaagatccagtcggtgattgggtgattttctgcctctagcatttgaaaaatttctagtttcggagcttagccacaggccggctacgatctgcttgttcatctgagtgtcggcacaagtgagtgtctgcccgaacccagaggtggggagcaaagagcctgatttatctaggggtttccggcgggagggtgcaaacaaatgggtcagcctgagggagcacggcttctagggtcccagggtcccccgcgatttccctagccgaatattttccacctcgtccccaccttggtggtgggaagcgcgagggcatgggaatcacactgactttgactactagccgctgtggcttatgaagggcaagtgagtttccctctcttagcctgtttccacgtctgtacacggggaagagtgagacctgcccgctgcatataagccagtgaatgtacctacaaggcagaagtcgcttattacacggcagccctctttgcatctccccacgggcgattctcctgcttcctggggagagtactctgaggattcatgtgctcgccctgggtctcggggaaggaggattctttctgcgcagggacccctgttctagtgaggtccttgcaggacacctgaggctccctaatcctcggtgcccatccgccgctctggaaattgttgtgtagcacggtgtgtgtgtatatgtgtgtgtgtgtgtgtgtgtatatatatagaaattgtatatatattgtgtgtatatatatatagaaattggatatatagaaatggaaattgtgtagcagggtgcgtgtgtgtatatatatatatacatatatatacacacacacacacacata

SEQ ID NO: 9653 - DNA, 1228 bp, Homo sapiens
gacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtat

SEQ ID NO: 9654 - DNA, 1168 bp, Homo sapiens
cctcccacctcaacctcccaagtagctaggactctaggcacgtaccaccatgcctggctaatttttgtatttttagtatacaggccttttccatatttccctagcttggttttgttggtttctttttttcttttctttttttttttttttttaagacggagtctcgctctgttgcccaggctggagtgcagtggtgcgatcttggctcactgcaacctccgcctgccaggttcaagcgattctgctgcctcagcctcccgagtagctgggactacaggcacgcaccaccatgcctggctagtttttttgtatttttagtagagacggtttcaccatgctggctaggctggtctcgaactcctgacctcgtgatctgcctgcctcggcctcccaaagtgctgggattacaggtgtgagccaccgtgcctggactggttttgttttctaatgcaatctgtgaatgatattttttttaattatataacttggatgccaagttgtattatcttgatggactgtataaattgcatttaaatacaatattttctaaatttctagctgctgtaaatattttagtctattggctagtgataacatattctgtggttagtgataattgaagcaactttttaatactcaggttcaagattgatcagtatttcagaatctgccttatatttgtttataattaggttcatctttttggcgcttctttgggaggctttttggcccagaaatttgctgaatacactcacaaatctcctagagtccattccctaatcctctgcaattccttcagtgacacctctatcttcaaccaaacttggactgcaaacaggtaagaacaaaattactttttttgttcagtgaaattttgaaaatgttggcttttgagtgtttggtacattaggaagggaagacttatatctacttctatattctgcaacttccttggctttttttttgagacagagtcttgctctgtcacccaggctgaagtgcagtggtgcaatcacagcttactgcagcctttatttcccaggctcaagcgatcctcctacctcagcctcccaagtagctggaactacaggcaggcatgcatggcaccacacctggttaatttctgtatatttttgtacagatgaggttttgccatgttgtcccatgc

SEQ ID NO: 9655 - DNA, 1120 bp, Homo sapiens
gtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccaggtatgttgctctataaccagtggagaaaatgaaaatactagattgacgctcttctcatcacgggtgatctcaagctaagaggtggtaggcaacaaatgacaccttccagatgcaattctgtgtcatagaactcatggatacagatagaacacattttctcattctgtcgtaatcataggctcagtcaccttgccttgagaaatacactgtggatatcaagcatgataacgtggtattgtgcttttctctttcagatgagttcccacttgctcacctcttggagcctttccgacagtattatctccaagccgagcactccctgccagcgctcatccagatcaggtcagaggggctggctctccatgttgtctttctcttaggtagcaggaagcacttgaagaagtgcttacattgtttaggtctattactgtctttttttttttaagttccataaggaacttaaaaaaaactatgggtttataatgtttccatgtttcaaggatgctgcatacatcttgtttagtcctcattagtccttgagaagttgatgtccctatttttataggtgaagaaaaaaactcaggttgtgacttgccctgtgttagtaggcacatatgcaaatacagaatctgtaaataatgaggattgactttatttgttatttggttatccataaggtttaagttcttcagagtttttcctctttttatatgtacatttaagaaatatagtcattttcttgattcctagaaatcaagttctgtaatagattagtatatcagtcatttgaaagctaagtcttagaatatgtagttgctgaacatcttatttggaataaaacagaaataaatagttgttctataatgttcttattaaggcatgatt

SEQ ID NO: 9656 - DNA, 1111 bp, Homo sapiens
tgtggcccgcttccagtgccaaatccatgggcttcccaaacccctgatcacttgggagaagaacagagtcccaattgacacggacaatgagaggtgagccacgtgtgggaaagacagagggaggacaaagaggtggccagtgactctggccgtagagaaggatggcccgcggctctgggagctgcagttggtgcccacaggtgcctgagatagtggtgtttctgcaaccacagtttagactgggtatccacatgactggctgggcccagattgtaggctcatggatgtgtctgaggatgtgtgcgatcgttgtcaaggctggaattgagggtgtgtccacctttgaaagtcccagtgtgtgtctgctgatgttgggatggtgcagtgcttaggtcctgggctgtatcttggatgcccagagtctttgtggctgattatgtcaatggctgtgctggtggccaactatgtccctcccctcaacaggtacacattgctgcccaagggggtcctgcagatcacaggacttcgagctgaggacggtggcatcttccactgtgtggcctcaaacatcgccagtatccggatcagccacggggccaggctcactgtgtcaggtgagggtccttcagcactttcccccaacctccccacctggcctcctcctcctccctacccttagatcaacccccttcagctggcctctgcagccttctcagccacgtgcgtgcagagtgccgggctctgtgctgcctggcgtgagggtgcacaggaatctaaggctggatctctggctcatttccccctgggaatcccatcctatgctgatctccaggacttccccattgctggcagccctgcagagcccgcagcagagggacggatgtctggaacgtcctggtctcctggtatctctctgcccacaggacctggtttctgggctggtgtttgtttcccacccgctgtgtcctgggctgtgggtggggtgaggaagcgggaaagtccccagctgaagtgaggatatgtggcgtcttcctcccaggctcgggctctggggcctacaaggagccagccatcctcgtggggcctgagaacctcaccctgacagtgcacc

SEQ ID NO: 9657 - DNA, 1428 bp, Homo sapiens
ggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattctaatgactgtgcttaaagataatttagtctaatggttctctgttagtgataaagacctttgttcaggcaaaatattatgtagcagttcagcatgttaaaccaaaaacagttgctctggttgaagcctgagagttacatggaaggtggtgcaaatgaaaaacactgatgatgcagacaaagccttgagaagttgcccaaagtcataaagctagctgataaattggaaccataattaactttggaatcggatcggtgatctgtcaggattacctagccagaaccttgcttaggcaatgaggcctaatcagtgtcagaaataaggaaacctcatgatttatgaatctatgccacttagaaagttgaaattatattaaagtgataagacagaccaaaagcaaacgacctttagtttcatagtgaaaccattttctagaaaatcaaatattttattttcattaaaaaaaaaccttgaata

SEQ ID NO: 9658 - DNA, 1130 bp, Homo sapiens
tctatatatatattttttattacttgggagaatgaattttaaaatgtcagtgctagtgtcaagtgttgtcctaggattgcatgttagtacccctaagcctgagtgtggggagtgagttatgcaagggtagcgtgcactgcccagactgactcatggagccttgtgcaaggagagccagagaggttcactataccatgactccaaaattgtctctattgctaatagatacgtatagtatacagggaaaacagcttataaatccaaatatcaatttaaattttaatattctacatgaaaacttacattgggaaatatgcagacaagtgattatattccaaattttacccttattttaatatctaaaatattgggtatgatgcaaattatactatagaatatttatctgaaatatgacttactggggtattctgttaatactatatataaatattcagaatttttttcaaaagtagaaaaattcccctctaaaagtacagccagatagattttcatccatattgaggaacttagctttttcaacaagcttcagaatctgaagtctgtagaatctaaaatacagaaatatccagaaatcagacaataaattgaaagtttagacatcatgagtattaaatagctttaaaaatatatttttagtcatattatttctaatgtaactttctttgggtaatttctggtaaggaaaaacatcttttggctgctagaattagttatagattttcaatatgtgtgtgtgtttgcacacattatcattagtgaaggaattccctagccagctttaaagaaggaaaaaatggatagtcccaaattaggtgtataaagccagtagagtccacgacacttggactggaggtatcttggagtcctgagacttagaatcagttcagctgcagaaaacccaccttttgagttcacaccattagtgaatagcaccatgctgaaacatttcacagcttccaactctgggaaataatggagagagtttaaaaatgtaaaacttcagttagtttggggctgaacttgcttacttgaaaaatctggtgctaggcacatatatctgcctctcctttgtaaataccactccaatattattctttactattcagatc

SEQ ID NO: 9659 - DNA, 1199 bp, Homo sapiens
ctgcaggaaaatttttgcacccgaagtattcagatccctgctaatagatcaaaaacagctatgtctaaatgtccaatatttccaatggccaggagtattagtacttctggccccttggataaggaagatactggaagacagaagctcatttctacaggcagcctgccagctactttacaaggagctacagtatgtattttggtgtatttttttatttggaaattgatcacttacgtatgattttgttccccttgtcttaagtagtcttattagctttattattgccaagaagagtctcttatcccatgatacaattatattacttttctactcatatgggaatcattgaattttttaatggcttagtattattttgcatttgccatttatggtttttatttattcaacaggattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaaggtatgagactaaaaattaaaaggcaatgaatgcttctgttaccattgtaatgtttgcatattcctaatgattaaaaagtaaggtctgtttttatgctaaatttattttattttattttttgagacgtagtctcactctttcgccaggctggagtgcagtggcactatctcggctcactgcagcctccagctacagggttcaagcaattctcctgcctcagcctcccaagtagctgggattgcaggcacacaccaccacgctcagctaatttttgtatttttagtagagacggggtttcaccatgttggccaggatggtcttgatttcttgaccttatgatccacctgcctcagcctcccaaagtgttgggattacaggcgtgagccaccgtgcccagcctatgctaaatatttttaatagccctctgggtcattagataaatagaattgttttagttgtatttacaaataatattttcttcttacaggctagcaataagagtcttttttttttgccttctcctaaaatttacat

SEQ ID NO: 9660 - DNA, 1206 bp, Homo sapiens
tgttggaatgtttacagtaggaaatataagtaaagtgtttagtatagtatctgtcaaatagcagacactcagtgagtgcttgctattatcattttcatcactagaattttaaatatttaagatgacttatatttgctattatattttcatggctaaaagcactttacttgtttttcagaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgct

SEQ ID NO: 9661 - DNA, 1558 bp, Homo sapiens
caaatatatctcctacctttatgtatcttttatcctaactatgataggtttattcacactaagtattgtggtttcttttttccttcagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatcccca

SEQ ID NO: 9662 - DNA, 1217 bp, Homo sapiens
tatcactatcagacaaaaagttctgttgggctgagttggagattgccaactccacgagggcagaaattttgtctgtgttgttcactgctgtgtccttaccgtctggaagaatccctggcacatagtaggcgctcagtatttggacacttgaggagtgctagccttgatgctgccaccatctttctgtgtgaacggggacacactgcttcccctctctgggtctcttcatccataaattgaagggttggcctcatctctggcatccttttcagctttaatgagctatgatctgaagtatctagttggctgatttcatttattttattcacgaggaggggccagagagagcaggagaggatgaggtggcagatttgatttttgatttcaggtctcagttagctgtggctcaccagcacttccccagtgcagggatttgcaggcctcatctcctgcggcctctcctttctgcccgtcctttgtccacaatttcccgatatcaccaaacagcttcttggccctccctcgcagatctacaggactggaagcctgggcggggcatgaggggctcaccccattcacatagcttggtcctccctgcctccactgtctggaacctgcagctgtttctccctttggataccttctgtgttccgtggtttaaggtaaactgctggagccttcaacttgagtcccaactgctggtgctcctgtatggctgggggggagtccctggcaggaagtccctggcagtggggactctgtgctggctgccacctcaggacatctgccagcaagcctctgggggatgggccctgacatggggatgccgcgtgtgcggatgcaggccaggcaaagacttggcagtgggggtggaaggaagcgcattcttgtgttactggggggctctgtgccaagaggagaaaaataaatgtaattaccttcactactgggatcctggcagagtgaggggccagcccagcctggctctagggctctgcaggctgagggtttggtcatgctaggaggagaagcctcctttatcttctctctttcttagaggcctagggtagggccagggagggcaccctagcttcccttttgcagccagtccccccacgatgcacccagcttgtgctgatggggatgggagaatacaatccagagggcggagagatgataggtgggtgccaagtcccacctctgtgtgctgggcctgg

SEQ ID NO: 9663 - DNA, 1146 bp, Homo sapiens
tttaatgttctgcaccatgcctcacacaaaggcattcaggacatctaaatttctttcttttccagatagatttatttgactggctgcagttgtcagtatggctatgtttgtatttgtgtttgtgtttccacttgtgtctagattggtgtgtttctctttgttgtctgtgtatgtgctgctgttatccacgtgtgtatttctgagtgtggtggtgtagatagggatgtgaggacgtctgtatatgtctttgtgcttgtgtctttgcgtgttgggttgagtagcgtgctttgtgcctgtgagcagctgtgtctctgtgtgtcagtgtttccatgatggcatgactgctctatgtgtgtgtgtattgcagggctggtatgcccagagatctccagggattcaggaagcttcacagtgcacaggagccctggacctgggtcccctctaaggtccctatggtgtcctcctccccgcaaaaaagcctcctgcagttcctggagaccttcctaattgccctctgtctgttttcctctgcctcccactggaggcacatggggcctaagaatgcttccgaggtggcagggcccctggtccatttgcattcgtgtttgcatatcatttgcattgtctatacagactgtgctttcagttctgcagttttcaaggtaaaatgtagttgctcttcttgaaggtcattatattaagaatttttctctgttttattctttctggtccagaccactctcccagaaccgggagggtagggcaggatagaagccccagaagcctctgctgttccgtcagcccctcctcctggtccactgcccctccctgggcctccagcttgggggacactgtgacagtcttccactcagcgggcctggttcagtgggtagagaccctgggccctgggaggaggagcagctgcgggggagattttcttacccagaggtagttgattcggcccagatcccaagagggcagggaataacacagtccaacttgtgcctattgcctgcttgcccagtccccatgacttactcctgttagggaaggaccaccatggatgtttcaacgtctgtatacccatctttggctggggaggggccacggggctgggctggccttataggaaacaaaggagtcaaa

SEQ ID NO: 9664 - DNA, 1105 bp, Homo sapiens
cactttgggaggctgaggtgggcagttcacttgaggtcaggagtttgggaacagcctgaccaacatggggaaaccccatctgtactgaaaatacaaaaattagctgagtggggtggtgcacgcctgtaatcccagctactcaggaggctgaggcaggagaattaacttgaatccaggaggtggaggttgcagtgagccgagattgcgtcgttgcaatccagcctgggtgacagagtgagactcttgtctcaaaaaaaacaaagccttggtacatctagaatgttgtatatcaaatttgttgtagaatatgaacttttgaaaactctggtgacccactgatcctatatagcacttgttaataaaaatatatatcaagataaaagtgttcatatacatatacaccattggataaagtggtactgggaaattaggcaaaataatttatgatgaaagtttgcatttcacttggagcgcagctctcggatataggactttagtgagacctttgtgactgttcctggtattgattgcatttgttagttgtacagtgcaaccatagacagtcacacacattaaaacagatggttcctgccgacagggtctgtatagttatcagattttctgtgcgatggctccatacatgtttgtttttgttttttaacttttaacagatgtggaagaaaatacaggttccatgtagaataccctaaagttatttataaactactttcaaacatgtaaaggaatgtgatttaggccgggcgcggtggctcacgcctgtaatcccagcactttgagaggccgaggcgggtggatcacaaggtcaggagatcgagaccatcctggctaacatggtgaaaccccgtctctactaaaaaataataaaaaaaattagccgggtgtggtggcgggcacctgtagtcccagctattcgggaggctgaggcaggagaatggtgtgaacctaggaggtggagcttgcagtgagccgagatcacgccactgcactccagcctgggcgacagcaagactccgtctcaaaaaaaaaaaggaatgtgatttaaataatccgtgatttaaatttcttggtaaaatatggtatgtat

SEQ ID NO: 9665 - DNA, 1206 bp, Homo sapiens
ttgattaacctggttcctggacctgattacattgaaaatgaggatttctactgttgtgattcagtttaaagttggtttgatttcattttagtgaatttagggtattttattttgcgtatggtaaaaacaataaaaccaacagtagtggggctttttaaactggggttttaaagcaaattaaggtggctcattctggattttagtaggttcttttgttcctctcattgacttgcagcatactgagtgagaaagacctaattttttcactttataaatgaggaaattgaagccctgagaggtaaagcatgttggtgatagtcatcccgggtggctggagtgaagtgggcagagccacagtgggagggggcctcctctctagcctcccactttgattatctgtctggccccagacctggagctttctttccatgataggagtacttctttgggttgacttctctggtgacagtattgacttgtgctccccactttggaacaggaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaaggtgagtttgccttgattaacaggtaattggattatttctcagggtacttagaagcctggggaccagggtagaaggaagactgattttactcaatacctttttgtgctgtttgaatttttttttttttttaagacggagtttcattcttgttgcccaggctggtgtgcaacctccatctcctgggttcaaacgattctcctgcctcagcctcctgagtagctgggattacaggcatgcgccaccatgcatggctaatttttttgtatttttagtagagacagggtttctccatgttggtcaagctgatctcgaactcctgacctcaggtgatacgcccgcctcagccccacaaagtgctgggattacaggtgtgagccactgtgcccagccgtgctgtttgaattttgaatgcttgttatctatattagattatggataaacacactaatgactgtgttagtgtattaatccccatcccatctggaaaataataagt

SEQ ID NO: 9666 - DNA, 1137 bp, Homo sapiens
tgtcagatcccatgggttcagggctcagtccccaagactgcaccaccaccagttgccagtctgggcctccaaaatgtctgactgactggctttaagttgggactcccatgatcctatctttgagttcgattaatttgctggattggcacacagaactcagggaaacacttaattttactggtttattataaaggacattgcaaaggatacagatgaagagacacataggacaaggtatgggagtggggtacgaagcttccatgccttccctgggcgcaccaccctccaggaacctccatgtgttcagctgtcctgaagttctctgaacgcagccttctggggtttttttgtgtgtgtatttttttttttttttttttttttgagacagagtctcgctgtgtcgcccaggctgagtgcagtggtgtgatctcggctcactgcaagctccgcctcccaggttcatgccattctcctgcctcagccacagccgaaagttatcacttgaaagaatagttagaacattgtcactaactggtctggtattctcgatcttaggatggaggttctctggatcaagtcctgaagaaagctggaagaattcctgaacaaattttaggaaaagttagcattgctgtgagtatgttatgaagtttttcttctaagttcctcattgataagttaatgagtcggtaagaaatggacaagagaggaagatgggaagtcaatgaggggaaagtttataagaaaagtggtattttctcactagactcttccctgtctggagtctatatacactattctctctcacattagaatgagaaaagtgactttctttatattaaaatctgtgtgtcttgaaaaacgggccaggcacagtggctcgcacctgtaatcccagcactttgcgaggccaaggcaggaggactgcttgagcccaggagttcaactccagcctgggcaacatgatgagacctcgcttctacaaaaaaataaaaataaatagctgggcgtggtggtgcacacgtgtagtcccagctacttgggaagctgaggtgggaagatcacttgagaggctgcagtaagccataatccatgattgtgccattgcactttagtctgggcgacagagtgagaccc

SEQ ID NO: 9667 - DNA, 1124 bp, Homo sapiens
cagtggttccaacatggttacccaacaggcagcactggccttctacctgtgcctttccttgactggatgagagtagtactgcctttggactgcagagaagactttaaaaaaaagtagcactggctggtgggaggggtgggatggggagaggagatggctggagcaaggagccaggcatttttcttatctcaacatgtgtttgcagcctcctccaaaactgcccagtggagtgttcagtctggaatttcaagattttgtgaataaatggtaagttggctccttgttctctggaagcgtatactctggatttgtcaggctccccaccccatttctggaagcaccagcattgcttctgcaggcagagttttgccctttaccctcccgtctgatgattcttggctgctgccataagcccttttttagagtgccaagacttatgtggcatgtctaactacatcatggatgtagtagctgctccttttggtacttgctctccagggattggcacgttgctttttgaccttagtttaactcagcaagaatgtattaacttactgtgggcatgatactgtgcttagaacaggaggatgaatcaagcccaggcaatcctcggcctctagtgtgcagagaagacaggcatgcaaacatgttatttgagctagaaccagtgccaggcaacagctcttaccttgtctttcttcctttaagcttaataaaaaaccccgcagagagagcagatttgaagcaactcatggtgagtctatttattccggattcttacagtacctgtttattcatttgttcttctctgtcagtcatctgtgcagtacttccagagcccattcattccctgcccactgtggtccagctgagcctggggctgcagaataccaaacaccagtctcctttgctctcccatcagtttaagggaaagctggggtgacccccgcagcctgagtaagcatatgccagaggaaatgcctgagggggccatgggaaagaaaaggccagcccacccccttcatggggatgcggcctttccctaatactgactgcctcatcttacattcagcctccttccagagtcactctccgcctgctgtctcgtttggtggcagtggaaa

SEQ ID NO: 9668 - DNA, 1443 bp, Homo sapiens
tgggttttgtttttttgtttctttttaacaccacgtcctctcgtttccttacatgcaggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagctacttttgcttttgtggtaagcttttcagtttctttagtacacaagaaatactggtttagccaagcaacactggtgagggggaaaggtgaagatgaggaggaggctggaaggcagaaacaggacaccgagttcagtgctttggactaatggggcttcctgtaatttcaatctctggactcagtccagctcttctcacccaacacccttatctgtgactcttccaaccaccttccttgtgggacctgtgaatagatcctgtatattcctttgatctcttttatacaagggaaaagcagctgatgggggactgggagcaaatctgagaaaaatgacaaaacatttc

SEQ ID NO: 9669 - DNA, 3153 bp, Homo sapiens
acataccggtttaaaaattttttaatcaaaaatatttcgtatcagtgatacaaaatgccccactttttctttcacgtgaacctttgttaaaattgcacattcttttcattctgaagtgtctgattaaattttaatcctttactaaatactaggtctgactacttaaatctgacaaatcaatcagggaatactagcgtaactggggaactattcaagtagtagtttagtatatccttagaaaacttccaacttaaacttgcctgttgcgtacccatcgcatttttatttaactgtcaaaatgatgagattccacttaattggtccgtgtttctgaaacacatgatatttgtggaaattctgacttggcaaacggaataccattttgcttttattggttgtataaaatgtttgattttttttttttctccaaaagtttcaggataaccaagtaagtgtcattggtttttgttaggtcatcgtattgaggaagttcctgaacttcctttggtagttgaagataaagttgaaggctacaagaagaccaaggaagctgttttgctccttaagaaacttaaagcctggaatgatatcaaaaaggtccgttcaatgagcacatttacagtttggtactccttgttcacagtttgtcactttgaatttcagaagataagggcagtatagctaatccttaatgtgtgagagaacaagaacctcagagcccgattacttgggtttgaatcctaactgctgtttatggctctgtgtaaccttggcaagttattgtgcccagtttaatcatctgtaaaaaggaattaaaactctgaagatctattgcagagattctatcttaatcagaatactaaaactgctcactttgtaggtctatgcctctcagcgaatgagagctggcaaaggcaaaatgagaaaccgtcgccgtatccagcgcaggggcccgtgcatcatctataatgaggataatggtatcatcaaggccttcagaaacatccctggtaattaaactgcttacatatattgactaggtatactctgcaagtctactcagcttttgttatgatgagattccacttaaggtccgtgtttctgaaacaaatgattttgtggaagttctgatttatggctgaaagagttgcaccattgatggttgaaacttcataattaataagttctcaggtaccttttatagctcttaagccataaagatgatttgtgtttcttttgttggaatacaggctccctaatttttctttccctttaaaaggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaagtaagtatctttcatatactaagcacagatgtttatattgtggatattaacattcagaattggcttacatgttttctaaatttattcccatttccccttatgtgcagcaacagtatgccaaaatgagactcacctggtctatatttttggttttttgttttgtttttgagacagagttgttctgtctcacccacgctggagtgtagtggtgtgatcgtggcttactgcagcctccgcctcccgggttcaagcagttctcctgtctcagcctcccaagtacctgggactacaggcttgtgccaccacacccggctaattgtagagttggggttttaccatgttggccaggctggtctggaactcctgaccttaggtgatccacccgcctcggcctccccaagtgctgggattataggggtgagccaccacacccggcctggtccatgtttatgagaagtgatagtgtagtagatattttggagagcatagtggctaaaaataaagcttcagttgagcttcctgttctttggttgattacttttacatgtacatgtcaatcttttccctttcagtcttcccatgcacaagatgattaatacagatcttagcagaatcttgaaaagcccagagatccaaagagcccttcgagcaccacggtaaagtgatacttagagtgtaattctcgccccaaccctatactattggttgtttcaaaaatttgtatgtgtataatgttaagtaaaatgttgatacagtatctgcttttttatagcaagaagatccatcgcagagtcctaaagaagaacccactgaaaaacttgagaatcatgttgaagctaaacccatatgcaaagaccatgcgccggaacaccattcttcgccaggccaggaatgtgagtggagtttttgtttgtttgtttgtttttgagtcggaatctcgctctgtcacccaggctggagtgcaatggcgtgatctcagctcactgcaacctccacctaccaagttcaagcagttcttctgtctcagcctcccaagtagctggcactacaggcgcacgccaccatgtccggctaatttttgtattttcagtagagacggggtgtcactatattgttaggctggtctcaaactcctgacctcaggtgattcacctgcctcggcctcccaaagtgctgggattacaggcgtgagccaccgtgcccggctggtttgttttgtttttgtttttctcttcctgatacattaagttcttacagggatttgattcttactgttttctgcctaatttgttgcagcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgacttggtgtgctctgtaaagcttggttagaatttttttaaagtgacattttgttggccataatttagactgttacattttatat

SEQ ID NO: 9670 - DNA, 3153 bp, Homo sapiens; identical to SEQ ID NO: 9669

SEQ ID NO: 9671 - DNA, 3153 bp, Homo sapiens; identical to SEQ ID NO: 9669

SEQ ID NO: 9672 - DNA, 1167 bp, Homo sapiens
attttgagttgtgcctttacatttctttctttcatttcctatagctgataaaaattattctgtaaatcttgaaaacctaaaaaatttacacaagaaaagacatcacttgtctactgtaagtgttttgcttctactcatattattttcttcaaattgttgtcaacctgccttcctagtttacaggttttttttcactcctaagatgactagatatttttctgtagtatgaaaatgtttatgtttattttcatatcagctaatgaccaaaattaaaatgccttcatgccttttagccaatctttgtggtttcaaagaattgtcttacttttctatttgggatatatggaaagtatatatcccaaaaatatatggaaagtatatatcccaaaagtatggcgtgtgtgctcttttttcttttgggacaaggatcaaaataatttgggtaatggactcttggccatgtggaagcacagctaaatgatctgctgggtacactcttttcaggtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctggtaagagtgggccctatttccttttcgggttcatgagactcctaaatgttggcttacttggttgttgctggtgctccatgcctctagccttggcacttgctgagtgtgagcttggacaactctgaaaggcccaccttgccactaacgtctcaccagggcagccagtgaaggttttgtcaggtgatctgatctatcagttgccctcagccctataataatataacttaagaattttctagtgatgaataaagtttttgagtggtggctcaagtgaatccgtgtttttgtttgtttgtttgttttgttttgagacagagtcttactctgtcacccaggctggagtaaagtggcacgatcactgctcactgcagcctcgaactcctgtgctcaagcagtcctcccgcctcagcctcctgagtagctaggactacaggcaaacgccaccacacctaattttttaactttttttgtagggacagagtctccctatgtttcccaagctggtct

SEQ ID NO: 9673 - DNA, 1221 bp, Homo sapiens
atatttttagtagagacagggtttaaccatgttggccaggctggtctcaaacttctggcctcaagtgattcaccagcctcagcctcccaaagtgctgggattacaggtgtgagccactgtgcccagccagattgattttatctatcaggtatgggacagtgctgagatggcaatcatttgaacattaaagtaatatttctggacagattttagagtgataaacaatcaagtcacaacagtttgtatactatgatgccatttttgtaaataattcataatatacattcattatatacagcaaaatcttaacattaactttaggaggggtgagattacaagtgtttttttttttaatttctgcttatttttattttctaattcttaaatcccagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttact

SEQ ID NO: 9674 - DNA, 1196 bp, Homo sapiens
ttcaaattctggcggggtgccctcctctgtagaacgaggagaaggtggcgtccttgcagagtgatcgtgaggaccaagtgagtcctgtgtgctgtgaagagtaagaagtacagtgctccacgccgggtccgtgatggttgctccacagtcagcccctcctttgggggcgtgcaggcagttgtctgtctctcctgctagcatgaagaggcaggggcagggtgtgcatggttcatgtctgcgtccgcagcatctagcacacaacaggtgctctctggcttgcactctgtggctcataacctttgttttctcctttgtgtgagcttgtgtgtgtgaaagagatgtcccgttgtgcgccatatttcctgaggacaacctggcacacggtgcccacatgactgctgaatgctggaaaccttacccagctcccactgtgcagacagcagtgcccacctccgctcctcggtgcctcccacctccccacccagaataacgcggcggtccctgtgcttgtcccgcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagtt

SEQ ID NO: 9675 - DNA, 1306 bp, Homo sapiens
ctgccttttcctcttccaaagtcctgctgagactttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagtagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccgctgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtcttgccttgttgcccaggctggagcgcagtggcatgatct

SEQ ID NO: 9676 - DNA, 1243 bp, Homo sapiens
tacctgaaggaagcaaaggcagctggtggttcctatcttcttgcctctggcagcacctaaaagaagcctcttgggccaatgagaggatggactgtcccccacctgcagagttctgtgaagtggtgcggacgtctttgttgatctcatttggtgcctccccctgttgatggctgaggaagccaaggctctgagaaggcacatggtttacccgaggggacacaggcaaggaatctgaacccggattgcattttctgttttagggctctttgtgtgaccacggtgcttcccaggcccacacttccagtgttccaggcccttgaccaccaatcctgtggaggggtcctcagggcaggcagtgggaccacctgaggcctgcgtggggtggcctgtggtgtgagggacccaggaagtcagcctgcacctcggcgagtcagaagatgtggccatccaccaaccatcagatgttcccctacgcttagggctgtgaccagaagtggcatcaagatgggaggcgaagcttctgggaccagagaaccagctgctcctgttcatcctgcttttgggtgaatagctgatgctctgggcccctcatcccaccatcccaccccgtggctcctcctgagcagggctgagggcatttacctggctgccttctaaagcagacttggcacgagacaatcttattcaaactctgctcaaaattgctaccctgaggagagggctgtgaccaggcaggacggggtgtgataacatggaacgcagggcctgctggagcaggccctgatgagtgtaaataactgtgttagaggcaggacctgagcttttcactccataaatatatattacttctaatgtggccagggccgagctgaagatcataattatgtgagatctgctttacaggcatttagggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcaagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttccctgagcctcagtttctccagcagtaaaatgtt

SEQ ID NO: 9677 - DNA, 1254 bp, Homo sapiens
ggtcttgctatcatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctctctgctctgtgcctgaatgaggggcatctagagggcttggaagagaagatgtggcacagggcagccggggagaggctggtggccagaagatggacctgagcttggtgaatttacctggcatctgagcctggcctgaacaattcagaaacctcatttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctc

SEQ ID NO: 9678 - DNA, 1429 bp, Homo sapiens
gccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcacctt

SEQ ID NO: 9679 - DNA, 1220 bp, Homo sapiens
tcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctgattcttgctgctgtctctgggtggagagaagatttaaaagggagccgaggcgggggtcccagggacttcagggctcag

SEQ ID NO: 9680 - DNA, 1291 bp, Homo sapiens
aggcaaaggatttctattccagtgggaagaaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgtagactttgtaatgcatatcattagccctcactgtgatcattactgctgtggctctgaactggcacatagtacagtggatggaaggtgcccgcacaccagctgagaactggttctggcctaggtgggctctagaaccatttacacagcatgaaagaaacaggttgggttaggagcagaaagaaataaggctcacacccctccagacactaccttataagcactgcagaacctgaaacagatggcagaaggaatggaatgctacaggggccagcaggagtgaccacagggaggggacagctcagtgactggagcattcaggaagaggctttccagggaacactggacattgcttagtgaccttttgttcctttttttttttttttcttttactgttctgaaagactttgagtctgtggttcaccaccagcccatcagtgtttctttgaggtgattgcattagggaagttggctctgggattgcaaaaaaaaaaaaaaggtggaacatgttttccttaaaagatggaaggttttagaaaatatactaggccatctggttagaaaaaacagaccagactagaaaaagctgtgaatttgattttgtagattaaacaaagccagatgattaaaatgtgatttatttataaactgtgctaatgtctattattatgattttgtggttttttattagggggtatgagtgagggaagccctatatccttcattggattagacatatatagtgaatagtggaagagtctgtcaagctcactattttaga

SEQ ID NO: 9681 - DNA, 1264 bp, Homo sapiens
tactttgacagcacacaagtaagactttgttttctatgaaggcttgaataagaaattattgcatgccttctttttttcccattacattttgtctgactatctcttttctgtttttgtttgtttatattttttgttccctctagaaatcgggccttgatagtgtctcctcatggcttccactggcaaaagcatggttacctgaggtgatgatcttggtctgcgatagagtgtctgaagatggtaaggcctgtggatgggacagtagttggtacatgcatttgccattccttgataaacagagtacatctgtttctttaacttaggacatacatcccatgtgactttatggctttatgaaaatattttcagctatttttctttggaatcttgtaatacttactttttttttaagaatggatacttcggggctgagaagtcattttctttttattattttagatgcctttagaataacattgacattaagggaaacacattgagatttgtgaagaatattgcaggaatagtcatgttttattttctttttacttatgaagattcttttgcatattattttaggtataaaccgacaaaaagctcaagaatggtgcatcaaacatggctttgaattggtagaacttagtccagaggagttgcctgaggaggatggtaagtgtttatgtgttaggagaaaatatggcacttagatatgagagattattttaattcagggaagaagaatcacagcaaaattcaagaaacttttttccccagctgtttcaaggatttaagcaaaatccattgatgtaatcttataatcttacacttagtgtaataattcatttttttggttttaccacctgttttagaacttttgaaaatgtgtgtttttcttatggataaaggtatagggctgctttctaaaatctttgtcatttccataatcctttttcctttccctactgctgaagaaggagagttagaccttcgtagtagttaaagttgatgtttcttattttgaattcatagtaacctaaggctgaattcccaagaatcgcaggggacatttcaaatccatttgaatgtcttttggacatttgaagccaaaagatagaccccaaatttaatcccccacctccaccccaggtagctctgcaatcgctgtcctccgctattgctggaccttctatttcttcccctcttctactccccttccccatttcttttctcatcttttctcctttgaagtacacctgttttggta

SEQ ID NO: 9682 - DNA, 1190 bp, Homo sapiens
aagtattatctgaagtagcatttgccttgtaaaacatgtgaaatagcagtactacattaatttcctcatcggtttcattcaaatatgacctgttacccgtagcatatgaatgctttttccttgttgcctccctttggcattactattacttagataggaggactagcttgataattacacatatagagcaaaactcatcctttttgtgcaaattctttgcaagaagattacattttcttatctacctacttttcctgaaaaactagggataggatgatgggtgtatttactgttgttgtaagccaaggtttgatttcactgtcacttaaaataaactctttcttctgtagaaaccagaaatcgttgaacgtggaggagttaagaccttacattttaccttcggttaaaaaaaaatgcttttcattaaatttgtgatttgaatttcggattgagcagatgatgtcatttctgcaacttggtgtggtgtgcatgtgtgcttttaaagaacaaacgctgtagatacatggaattagttacatggccttttctggtccctttttagacgtgaagccctccaatatgctagtaaacacaagaggacaggttaagctgtgtgattttggagttagcactcaggtatgtctcttttcctcccagtgtactgttttctctgcaacaacccctttatattttcattctgttctctggattgaaaaatcacctagctgccagacaaacagaaactctgcatcttttcctcatctgggagtgtgttattcatttttaatctctgagcgagtttccttcatcagaatatgattgttcattgtttaatgacagtaaaaactgctgatattgtaattactacttacgaatagcaaacttcattgatatgcagctttgatatgaaagcgttttggccagacaaaagggagggcagagtgggagctgtgcctggggagcccaactggcccacaataaaaattaatattgggagcaacaatggtggagggccattacaatgtgcagcacaaattttaattaatttccattttggacctcccctgagaaacccagtgatagtgacccatgagcatgctgtgatgttgatttgaattgcagccacctttactcccagccaaacacgaagaccaaagcgaaggtcatcgttgtattatgagttgtcaaag

SEQ ID NO: 9683 - DNA, 1100 bp, Homo sapiens
atttgtttagtgcagattgttgatttgacaatgcacaagctgttagaataacgttaggatcgagcattagtaaataataattatagtctattctttctaatgttttgcataccattccctgcctttagattactacagtcagagcaaattcctaccaattttctttcaccttctttaaacaatatgcattttacagataccagtttagaggttttcgtcctttgtattccaacctaataaacagtttcagtgccccaacttctttataatatggatttcatccttgaatataaaataacagtacgtttcctttttgcatcatgaatgctttccaggaaggtactttcctccttcatgttccctggagcaaaatctcagttttcagggtagtttcaagttaaagatcacccctaaaaacctctgcaatttataactctgcaggtttcatgtctagaataaactggtctctttttttggtctctgtgatggttgggaaattcttgcagttagtcacatttgagaaaacttggaacaggttctagagatggagacccatttaccttgtgcattattatgctatggctggatagctcagctgttaaaacaaaggaatagggtttcataaaacagatatttgtttgtaaatgcatgtttcaatgctgcaatgagttggccacttataaataaaacatctgcagatcacacatacgcccataaatgtatatggatgtatatgttggtaaggaacaccactccagggtggcacatcataaagacaaggctaaagggtgagtactttcagtgccttgaaagcaagtgatgtgtgtgtatgtgtgtgtgtgtgtgtgtgtgtgtgtgtgtgtgtgagagaacataggtatttagatatatctctttacaactctataccctgttgtgtgctgtcccacattttaaattaataaatatcaataaatcaataaaatacaatgaaaaatgttgtcacaggaagcaccattccatacttaatttaacattatttctagtactgctcactgtttgattttaaatgaatgcattcccagaggtatagcagtggtgaggcaccactgctttggcag

SEQ ID NO: 9684 - DNA, 1153 bp, Homo sapiens
cactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgcgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacagcccca

SEQ ID NO: 9685 - DNA, 3407 bp, Homo sapiens
acagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcagtccaccctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaaataccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgcaccagaggtccattagtgatttatatattgcatgacattttctatttgagtttgacatgtagagtcatttttagtttcatggcaattgacagtcctaataactcagctaatttgaaactaacaatcttgctgtgtaaaaggaaaaaatggtgtttgtgttcagtaaatgtttgaaaaaaactactttgaggtttgtgtctttattaattattcagtgtgccttagttgcgatgttcttttgttgagtgccttaaagttgtcaaagttatatatgtgcatgggaaaaaattcacgtagtaaagaaaaattcaaatatatattttaaaagttcccttttcatctctccccgcctcctatttggactctgcagagacaatcactattaatagttttttgagtagcttcccagaatgtttctgtgcacatatgtattatttctccttttcagtttttaaaatgcaaatgaacttctacctttgcaacgctattctgtatcttatctttttcatgtaatatatcttaggcattttccatttctatatgtataggtttttaaaacaacttcatagcaattaattctgttgatggattgaaaatgtatttaactagattttattgatggacttttagattttca

SEQ ID NO: 9686 - DNA, 1200 bp, Homo sapiens
gctgagctccagagagattgagagacttacctggggacacatagcaagtagcaggtttggggacaatgagaacaagtcccttgcctcctgtttgtaagaccctttccactgcccctggctgcttttcgtgacaagaaagtcagtcttgccaccacccataggacgggctttttaacatctaggggaggtcttaacataaagtagttgccatcctaagaggccttcctgggatttggggaggggtatgccatcctgcctgcagagaggctgagaccagctcttctccctcaggaggacctctccatgcccctgatcgaagaggaaattgatgggctctctggcctcctgttccccttctatgatgctgacacccacatgctctacctggctggaaaggtagtaggaggtgggggagggcccggggcagcctgtgggagagccctaccctcaatgcacccctgcacctgccccaccccctggagagtagccagcctaaccttccaagttcctgggcctcacctttcccatccacacctgccctcaagtctgacacccattcttactcaagtgtctgctaccaagaattccttcaaaggtgagctggagcgggcttttacattggaataaagatcagagcctgcagtgtagtcagtgatgaatgatggaatttgagatacccgccaggagatccttggtgaatacagccttgtttgtcagaaaggctgtctacacacacacactcacatcagcccatccacctccacctctccacccgcagtgagtcccctgtggtgcacccactaggagcctagaagccaggtttccttggtttttttaactgcccatgaggcacaggggagagctgtcttcagctggctcctgggaccaggccctgctctgccctccctacctgccaccttcctcaactccatctctcctgaccccagggtgatggaaacatccggtactacgagatcagcactgagaagccctacctgagttacctcatggagttccgctccccagccccgcagaaaggcctaggtaagtggccccgaggctgccacagctggtgtgctcatggcacgggaggacatctggcccatgggtcaccccctcccttaagtggaaaatcagactcagaaggccatagcacatgggcaagttggaacagaacctgcaagagctggccctgctgca

SEQ ID NO: 9687 - DNA, 1961 bp, Homo sapiens
cgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaacctgggcatagccatctcatttaaccccagtggttcctgttcttggtcaccatggtaccttgatggtcagctccccacccacagctcctttgcctttctggaatgacaacccacgtctgtacctacagatataatttcacaccttcatttatctcagcactattgacatttggggcgaataattctttgctgtgggggctgccctgtacattgtaagatatttagcagtatccctggctccaccaatcagatg

SEQ ID NO: 9688 - DNA, 2394 bp, Homo sapiens
ctcttgaagccaaaactagattgaggacagatgcaagaaaggatggcctactttgcacgtcagggagtctgctcgggaacttgttctcctcagagaatgtgcagactggagagctgcctgccttacagggacttcagatcagagttcttaacctgggtcctggaatccataaccccctgaaactgcttgcaaatattataaatgatacggacattttctggagaaggagttcaaagctttctgcagatttcccaatgagtccttgatctgaaataaattaagaacctctgctttacattcctcccgagatgtcaagtcttggtgggggctctgagaggctgggggtgaccccggcctttttgtgctctgtgtggcttcctcagcatgtcccaaggcagggcatttctaatgttctggtgtctgtcctttctcctaggaggatgaagaaggttataacgatggagaggtagatgacgaggaagatgaagaagagcttggtggtatggcagcctttttactctcagctggtagcagcctggccctttcactttggccttagattgcttagactcagaggcccctggcagtgggcaggacactcctgtcagaggcctcagattccccttccagctgtgcagatgtcttgcctcggtttccaaggatggcacagcttgctagtcatgggtcccctgacttctcactgggtgggttgagttaaagaggtgggattaataactaatctaaatgccgctttcttacttttccagaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaacccagaggtttacatatgg

SEQ ID NO: 9689 - DNA, 1150 bp, Homo sapiens
ttgatgagtccccagtcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattg

SEQ ID NO: 9690 - DNA, 1163 bp, Homo sapiens
aatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttcttaaaaagaatatacctggatatttctctttcttctcaaattattctaaggttatttgagcccagcaagcagatttctgaccatttcctgttcaacccgtgaccagaagtcaggcaacaaatgttgttcatcaaaggcataccaagccctgtcagacaatgtgtgggaacaaagagtatgcatgggctttaatcctaaggacccttagtcttcaagggggagcacaatgtatactaaaaactcgaagaaaaataaaat

SEQ ID NO: 9691 - DNA, 1161 bp, Homo sapiens
tctcatcctcctacatctacctatctcaaccaaggtcctgcgctaagcaggggcctccaagctgggacgcagcccttactctcagggtcagcgccggctgggaaggccgcgacctaaccaggagattacgaacaatgtcaccagggccacagcggagctcctgccaagtcaagcaactcatggaaccaacggaggcgaagtccgaatacctaggcaaccctaacctaaaagtgtttttaacgttctcaggtcctataatttacccaaataaagtgggaccgtatttgcaggcgctgagaaactttctcaacagtaagaaccaatcaggcgcagtgcgcaggcgccttcagtgggtcctgggtccgcctcttccgcccggtgcgggcgccgattggtccgcgtggacacataagaggctgcgtataggcgcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggtgagtgcgggcgcgggccggcggccgggctgcctgtgggcggtgactttcggctctccatgcggttcccggctccaggccgttcgactgagcacttccggccggggccaggccgcgaacacaggccgcatagggcgggcgctcctcggggctggggcctctctccgggcaggtcctgggcccccgggaccacgtgcgggcccagcgggcatggagtgcgcttgaggctgggcgctccggctccaagagccttcgtgtagaaaagctcttccgcagtgcttgggcaccctgacccgtgcctcgtctctctcagggacacttactcggacctctttcggtgtaattgccttgaattcccccggtcgtggaggaaggcgcccgagctcggctccacctcccaggtcttgtaacttaaaaatagccgcgtgactcaggcaagtcccagcccgtgaaacagcagtgatgggctcgcctcattgcagggcgcctggcacacatctcttttgcttgtgatagaatattt

SEQ ID NO: 9692 - DNA, 1349 bp, Homo sapiens
gagacatggaactgtggaaagaatattcatttgagtgtttcaggaagtttggattttttttttaccaacatattatttgtaaaaggagggaaatcagctgcctcaggaggttcttaacatataggaatgtaattatcagattcaaagctgaacagtagtgcgttgccctgtaacctaagtcttggctgttagcaaagaaaagccagtgtctggggtattggttccaggaccttccactaataacaaaatcccaggatgttccatctcttatataaatgtatttgcatataacctatgcacatcctcctgtatactttagaagtctacatgtttggtacacatgcttatttttccactgttgaatccatggatgtggaactcactgtatatagtgttaggggttgatcactgtaacctggaatgggggatacttttcgtttttggctgcgtgagtgcttaacaaggacagaactgggcgtttacctatgcatgcacatgtattgcaggccctggccaacgtcaacattgggagcctcatctgcaatgtaggggccggtggacctgctccagcagctggtgctgcaccagcaggaggtcctgccccctccactgctgctgctccaggtaggaaacatggagtttttagtattgggaggagtgtagagattttttaaaaaatagtattatagacaaaattgccattaatttttcacaagtatatgaagtatggaaatcctaacacctgattgactttttttttctagctgaggagaagaaagtggaagcaaagaaagaagaatccgaggagtctgatgatgacatgggctttggtctttttgactaaacctcttttataacatgttcaataaaaagctgaactttactgctgttggtcttgtccatagttttggaatgtgctctgcaaaaatggtctgttttgtaatgttggctttcagcctattctgccatgacacaggctggattttccctgccaccattgccggatgtgagatttagacaatcctgatgctaacaagaaggcacctcatggtacagtgttgaaaactgcactggggtggcaggaggaaggatcagagcagatgctttgtccaggttacctgtgtaaacttgatgattataaggtgtgtcccctacactgggggtggagggtaatacagaccagctttagaaagcctcctgggtatttaccctatacaaccctgcctaagaacgaactttgacgtatgctgaatgttgactgctacatcccaaggttgtaaaaaaacaagacttagctatgtaatgtctcaccaaatgtttgggagttttatggtaacactgaaggagtg

SEQ ID NO: 9693 - DNA, 1128 bp, Homo sapiens
aactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctccccccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatggg

SEQ ID NO: 9694 - DNA, 1246 bp, Homo sapiens
agtggccacggccaagagacttgggaccaacctgagccatctgggaaggcttcctggaggaagcagcagtgaaacagatggagatgaccttggggttggacacatttggcccaactgtggaaattcgattcattctctgctgctattgagcactttgtcctcggcgtcctcattcacaagatggaaataatagtagcaccctcctaggtctgatgtgggcacctgaaatgatccctctaaaaggcgtagccataaacccgactcacagaaagcattcagtaaatgccagggattattatttcttatttgcattcctcactttaatattttaatcttaaatttttaatattttagttttttttttttaactcacttttttcttaaggaaagatgaaagtctcagagacagagtaactgaatgcaaaatgtctgtgctttctcacctataaaatggggatggaaaatgacctcccatactcctgggttattgggtgggtggggagggaccctgagcctcagaggacctgagcagcacctttgggagccgccctcctcttgagggcagagaatgctgagctcagtccatctgccctcccaccacctgcagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggtgagccttggatgggcccaggcctgatggagtggggtggggaacccagggcagcctggcccaacaggacagaagaggggcccaaagcttatagaataagctaggccctggaaccaggcctcctgacccctgagctggtgccccttcaacacccttaagtgatcttgttccacatccttgtttctcggatgcagatgtcaccatgagttattgaactctcaggacactaggccagagccagttcttgcaggcttggggcaaaggaacaggacagtagcagtgcaggcagttcctctccatggttacaaccacttgctttggcatctgagagccttggatgggaatgtctgctcctccactgacaagctgtgcagtcttgaacatctcaccctctctgaactctagtggatttttctctctggtcgggaatagcatggtgctcatggctttcagggagcataagggctttaacacttgtagagccctgg

SEQ ID NO: 9695 - DNA, 1122 bp, Homo sapiens
ctggttcctttcccctatttacccaactttgacctttggctttcctcctagcaggaggtttggattttccctctggccaggctttcattcctttatctactaagtacttatacaggacttactggtgccaggctacatttatggaggcacaaagagtgtctcctatctggaagaagaggccattagacaattcactgtgtgtgtgtgtgtgtgtgtgtgtgtgtgtgtgtgtgtgcgcgcgcgcgcgcgcgggtggagcgggggggtggttgggggtaggaagatgcacagaggaataaattgttgtccttgaactctggcaactaaccagaggtcagccaatagtattttatccttaattgatttatcagattaagctttaatggagcagggaggaagtaggagcaagccaggaagccattacaatggaagagattgtgctcaagaattccatttgatcttcaaacaaccccaagaaggaggggttttccccattgtccacccagggaagcaggctcagagaggccagctgactttcctaaggtcacccagctggcagtagagggtcctggcagcctgatggcattgttgggtgcactcctgaggccacgctgatcccagggcagggaagaatgccaggcacccctggtcaatgtcgcttcctgatcagccttctaaggatcgtccgggtctgcaagtcccttccacgggttgactaaagctgcctctttgctctggaaaccctctaccttccctcactggctcatcttcctggcttctctttgccttggccctgggggcggaaggggaacagctgagttgtcatctaagcttgcatcttccagggcagcagaggaaaaggacattgatttatgatcaaaaaggcgaaggaggatgccgtggggaggacgctggtcggcaggggtgggtgggcgataagagagaactagaaagaataaaaagaatccctaagccttaaaaacagagcttgccctctgattcctgggtaggcgtgggttgaaaatctttcatgtaaaactgaaatggaatcacgaatgaggagaaatcatcttggggcttgggtgtgccttacaggactgaattaaatttaaaatgtattga

SEQ ID NO: 9696 - DNA, 1180 bp, Homo sapiens
gcagctgttgtgcactagtctttttgttttttcagatggggtctcgccatgtcacccaggctggagtgcagtgccacaatcttggttcgctgcaacctctgcctcccaggttccagcgattctcctgtctcagcctcccgagtagctgggattacacccgtctaatttttatatttttaccagagatggggtttcgccatgttggccaggctggtctcgaactcctgacctcaaatgatccacccacctcagcctcccaaagtgctgggattgcaggcgtgagccaccacgcccggccgtgcactccttattaattgatcttattttcatgatagggctgtactcccttttccagtaattcctttagaaatcacaatgatgaggatttagcatttgatgaatcaatgactagttatgctctgtaaaagctttatctttagaattcttatgtaaacaaagatgacataaaataatgctcctctttcttctttctccgaagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactttgccctggattgactacatatttttaaaccttcaagtccctaataaaacatgagccatctgagtgagtccatatgaagcgaggttaggctgaaataattgcttaaagatgtctttcagagaaattaatttggttggtggccacttttaggtggatcaaaagacctttcagatcctcagaaccttgagacataatacagttgtgaggaatgtgttgtaacttggctggccaagttacatgttacagtatctttactgaggtaacttcattagtgtctttggccttttttgtaggtatagatattttttctttttacactaataacttttatgccttttaaaataaatttattttcataaatggtttgcagtgctaaa

SEQ ID NO: 9697 - DNA, 1147 bp, Homo sapiens
catagaaataataaatatgttttgataaagttgatgatattcatgtgtgggtaggtgttaatgaatgggggaagaaagacaaaatagcacccagtagccatggccattgtccgttgttctgccagaaatagacttacgtgaacagaactctcaaaatgttgtgaatgtattaaggaaatcatatccagaactgtttccttaccacaaaaatcagcattgtgattttttttccatcttactgcctaatctgaaaaccctttgattcctgatgatgtgctaactttctctaagtttggcaaataagtatagtaaatgtctcatttaggcttttgtgattgatgtctttttttttttcttttcagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagag

SEQ ID NO: 9698 - DNA, 1182 bp, Homo sapiens
agaaaaaaaaatcgttagagcattaaggtcattattctagatgaaatataataaaaacctagtaggtggaaataaaccaaatgaaaggaaaggaaggaaggaagaaaagagggttgtgagggaggtaggagaaaaaaggaagaaaagggagagagctcttttcctaagcagcctgaggtaatctgtgaaaatggttcgctattcacttgacccggagaaccccacgaaatcaggcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacattacaacggtggagttggcaggtgtgcgcaggccaagcagtggggctggacacaaggtcggtggcccaaaaagagtgctgaattcttgctgcacatgcttaaaaacgcagagagtaatgctgaacttaagggtttagatgtagattctctggtcattgagcatatccaagtgaacaaagcacctaagatgcaccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaagggagagagagggaagacagaagagacaatagaaaagaaaaggcaaggcaacaaaagaaaaaagaaatgggagagagaggaaatgcaagacactgggaaacaatggggagaccattacctgcacatctaccccaggaactgtagggaccagtgtagaccctcccaacccgttttcataagtgaactcccagggaaagcttatgaaaataatctctggggctgggcacggtggctcacgcctgtaatcctaggactttgggaggcagaggtgggtggaccacctgagctcaagagttcaagactaccctggtcaacatgacgaaactctgtctctactaaaaatattagccaggtgtggtggtgggcacctgtaatctcagctactcaggaggttga

SEQ ID NO: 9699 - DNA, 1100 bp, Homo sapiens
cttgagctcaggtggtccacccacctctgcctcccaaagtcctaggattacaggcgtgagccaccgtgcccagccccagagattattttcataagctttccctgggagttcacttatgaaaacgggttgggagggtctacactggtccctacagttcctggggtagatgtgcaggtaatggtctccccattgtttcccagtgtcttgcatttcctctctctcccatttcttttttcttttgttgccttgccttttcttttctattgtctcttctgtcttccctctctctcccttttttttttccttttaattacatttattttaatgctgaatttactcccgtgccataagtttttgtttcttcagtttcttctgggatatctttttcttctgggcaacctcctcttctggtttaggaacaatctgttccttttccgtaaggatcatctcaatgtggcagggagagctcatgtatgggttaatccgaccatgagctctgtaggtccggcggtgcatcttaggtgctttgttcacttggatatgctcaatgaccagagaatctacatctaaacccttaagttcagcattactctctgcgtttttaagcatgtgcagcaagaattcagcactctttttgggccaccgaccttgtgtccagccccactgcttggcctgcgcacacctgccaactccaccgttgtaatgtcggaatggtacacactgtttctgtaaagtgacatctttcagatacttcgtggcttttcgtatatgcatacccttgatggcctgagcagtttcacgagtgttcttaaagtgaacacgaagattggaacctcttgatttgcctgatttcgtggggttctccgggtcaagtgaatagcgaaccattttcacagattacctcaggctgcttaggaaaagagctctctcccttttcttccttttttctcctacctccctcacaaccctcttttcttccttccttcctttcctttcatttggtttatttccacctactaggtttttattatatttcatctagaataatgaccttaatgctctaacgatttttttttctaaaagtagcttgtgttcaacat

SEQ ID NO: 9700 - DNA, 1396 bp, Homo sapiens
ctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaaacaaaaaaaaaaaaacaaaaaaaaaccgtgattgtttccattaagccatcagagcgtgtctcagatatcttgttatacagtgaagaagagaatacctattttttttgatgatgtttgatgtcatagtaatcagtgctggtttaactcctgtttagttcctgccaaatacattgcatgggctgaagtgtcagtagccatactgttctcatgtttcttggtcctaggatcagattcttctacattattttttagtttcccagagacatggtgatccctaaacttatgaaggtttcatcctaagccattcaggcttttctctttgtatagattaaaccgaaaaccgcatatgagcctgttcatctgctggtggattcccaccacagactcagactcaaacaaacaaacaaataatgtgaccgtttagttagtttccaaaaacattcacatacaatattgcatgaataagtaagtaagtgttacagaaagctgccaaaaaataaaaaggtttttaatatgacctatctaactaactaacttttatcttccttttctcagactatcagtattaaatagatggaaaaaaatcaaggactacttgaagctatttttgttaatattctggttactgaagtttattgtaaatatgtatgtatagtaggcatatttctttttaaccttgtgcttccctccttcccatggaatttcttcccacagatgaggggccactggacagggggatgagagccattcgtccctgggttgagggaattagtaagacatcattttcaccactgggtggtcttcatacacatgagttataatagcattttaagtatcttagcatttgtgggattagaaatctgtttttgctatttataatatataaaaaatgaaacatgatagcctttcttgagataagtatgtgaaatgtttatt

SEQ ID NO: 9701 - DNA, 1183 bp, Homo sapiens
taataaaatcaaggagcttcggcagggtctagatacaggtaagatagtgccctctaaatcataatgaaatacttttatttaaatagttcctttcatgctcttaaagttttcattacatgtcaatcctttacttagcagccagaagaatgcattcttttctgtgatgctttgttatcattttttggctttctaaagagtctttggtttcatttggtcaactcagcagacatatattgagcatataatttgcacttgggacagatctcatttaatttttgtaataatttagtaagattgtgatacctctgattgacaaagagaaaaactaaggtatagggaaattaaataatgagctgctgatgatgatgcaaggtgctgtactaatgtttttataatattcacaacaatcctatgaattagggatattattatccccatttacagaaaaaggaactgaggcttacagaagatcttgcccaaagactgatcgccaataagtgaccaaattggagttaaccccagatcttctgaattcataatctatttcccctttctctttattattctgactccaaggggtactctttcctgtgtatcatcttcttgcctgcctacactgatgacagttactcaaactgataattagtgagttgagcatgtatctttgtagagctgtagttttagtactggaattcatgcaggggactgactctggtttcattctcaacttctacattttaccactgttgggaaggaatagatctttttgaactaaacagagtaaagcatgtccttgtgtgggcaagaacctgtgttcagtgctgtttcttatgaacaaatcaatgagaaatgaattgagtatgaaaataataacaatgactggtaagactcaggcaggaggttccgtctacaagagacttggtctactttggtttacaggcagttactgactttgtctctgataccttgaaatagcacaagtgaaaatcaatcatcctgaatcttccccagtcatctaatctgtatatccttagggagtttataagtgaaacgggtgaaggtgtttcctttacattttctaagctcagttatcactgtccttttatctctaagaatgacttaaaattagccttactttcagaaagtgtcctgtatgcgttttttcatttgtcatgtaaaccat

SEQ ID NO: 9702 - DNA, 2556 bp, Homo sapiens
agatgtcaagagtcaggtgctagtcacgtgctgcttggcttgtcactgtcattggcagcgagaggaatgggtgctggtgacattgggccagggctgcctctctgtgtcagagttcagggtgtaggaggggttctgccaaccatgggctgtgtggggtaagtgggtgaggctgatcttgctgggtcaaggtgatcctgagcccttggcctgtggaatgggggtagagggcaaatggtaacctagcatgctgtgggggatataggatgaggggctgcccgagcctcgggaggggtcctagggagcagatgttgaagaggccagagccctcagtgagctggatgagagggtgagctgtttgaacgccctgagggtacttcctggggcctcgtgtaatggtctcttctgtatgtcccccatcccatctcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggtacgtggctggagcaggggctagagcctagaggagcttggggatgcttgagcattggcttctgtgggaccccgaaagtttggggaatagaaaggggaacacacagaccttagtggggcaaaaggcccagcgactgttcctctcccttattgggaatgttcattctgaatctctcattctccgaagtcctaagctgagccaggagggaaaagggtcctttgagttgtagggctgagcaattcagttcctcttctcttctagtctggggctcaaagcaaaattgtccattttttggcatctgctcattactgagagttttttttgttttttgttttttttttaaataaaattggccacagctcctgtgctgtggggtggcatacacagattacgtactgatgtggccattgtccctgtataaggtagggtatcatcagatgacaggaagcagctagctctgaccctgggcaaggctttgcaccctctccaggatagtgaatgatgtccaaaggtccctgccaaccctgccatctgagtgataaggacatttcagggccttcctcctgtttgcctgggctgtgagtttggtgccaccttgtggtgtgaggaagtagtggtcagccagcctagttcagtactcaggctatggggcagctgcccaggtgcaaacctgcctggcttggcttttactcaccaacctcccttctcttcctccaggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacctgtttcctctcttttctgctggggagggggaggtggttgaaccctgccctctgagcaggctgggaatggctgcagcctcgtgccccgcagtgggagctatggtggtgtcacctgccatcctgcccacctcctggtgcagaggcgctgggaaagcagtagcttactatcttagggttacaggttgcccccttcagtgctgcggggagactttaatggcttacgtgaaccgaagatgggaaagagcagggacaaggcctccctcccactctggtagataaacccaaattgcaaagtggccttggccatggttcttccactttggtcttcctgcattagcgtatcccttatgggggctgtaggaggagtcagctctgggcgcctgagactgggtttggctcccaggtcctcagttgtggacctaggctccccttgggacccctcctgtttgctggtgccctcccaccatgatgctgtagtgccaaagggctgggggagagagttg

SEQ ID NO: 9703 - DNA, 1100 bp, Homo sapiens
gaggaacagaggctgatcttgacttagatatactgaaccatgaaatcactgcatagaatgtggggacttgaatgtgtctttgggcaagtcatttaacctcttaagacctcatctgtaaaatggattagatatgtttaattatagccttagcattaaatattcattgctgttattattaagtgtctgataagtctctgtgtacatggatgtaatcttcctaactcccattacctccatttatagatgagggttatatggccaataaagcctgggtttgaatctaggtctactgcctccaaagccagtcttctctcctgcaacatcatgctctgtctagcaggagatgagaacaggtctccatttggagcctgtcagtggggtcagagactaagattcaggctcagggtctaaattccatatcctttcttccataccctggtgtttcctatgaacagatagatactttagggctgcaaggtttggattgcatggcactgctcagaagataagttacaggtctgggctaggctgtagctgcccctccaggtggctagacctttcctttctgtgtcaccagttaacactggccaacagttccttccattaactgttcactgctttctcctgtgtctaactgatgcagtttatgacccataactaagagcagtaccaggtatggctctgtttcctgttcatgtcccctgtcctctgggctgcatgcattccgttcttacagaaagaatacctttaacctagtacatcctgccacacatctgcttctactgtgaaattgatgagggggtattaccgattcttccctcacccatcatttactgagatgctggtgattgcattataatcctctaaagcttacattgtctttctgattcttggtcttatctgagcaagtgatctataaataactcagtggctttctcatgactgttttaattattagattttaatcaagtgtcttattaaatatatctgcatgcttccacaggcatctgtctcttcacatggctgttcagtgtgcctctcacaagttagcccacgttttctgttctcctgcttcaaactcagttgagctgccttgcttt

SEQ ID NO: 9704 - DNA, 1027 bp, Homo sapiens
gtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatgtgcccacccttccccacattctcatgtgcacactcgcatgtttgtatgggaaagctctggaggctgtctgatctcttcccatggaattgtcgcacgtaacacacagataatccccttcccccatgtacctacacaaagccatactctgtgtacctactcactatccagaggatcagcttgctgtcatttgtctctgaagacagctcaagctacatctcactaatgctctgtcccctcccagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctggtgagttctggggcctgccccatcccccagggcttcggactgggcctgggatggatgcaagctctggtgcagagctttttaggtttctccatcctcttatgcacagcctttcattatcctccaagttacagcagcaagagggtgggggtggaagtggaggtggcttttttttttctcctgttctgcattcctgcccacacccccacccctccatttccttctgctctggaggcatcctccttcattggacaccacacagtttatttcacttctgacttcaaggttgtgaattcttcccatggcttaagtcctgggatacttctgcagtgaaaggaggtcttgtacctcttcctcagagtcagaagttctgagtacctttgccctattctgaaaagggctaggggctcctgctcccagctgccctcttcctttggcttccaattcagttccctctgccccgcatcctgcagacaggcg

SEQ ID NO: 9705 - DNA, 2262 bp, Homo sapiens
catcaagggcgtgagtattctgcggagagcgaggggaaggctcagtaggcaatatgccccagagacatgtcctccaaagcgctgggttgccatgtttcttcccagtactatgaaggactgcagaggagttgaggtctacaaatgaggatttattcatcactgtaaacaatgttgatttgatctactttgctaggaaatggtaccacaaaggaaccttttttttttaccctaaaaacctaaactttaggctttctaacttggagaaccatctctttgtatctttttccccatcattaagtagcataactgaaacatattcttttcttggattatttccgtgaagtatacagagttagagaataagagcaaaaaactgtattacttttagcagtgacttgagcattgttcccgggaggaaagagcttttccattccttctgaggtgatgctgctactggtgtctccagtttggactcttgcttactctcttgtccctagagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtacgtatgggagctggagtccagttgtctaaaacagtcttttgtctctaaacttccttgacacaaggaagatgggaaggttggttgcctggcagtgagattgagtctgtgtgttctcaggaatcccttttataactcatttatcctcaaagataggctttaatccagcatagttacattcttctggttctggagaacacaggaacatacatacatatatatatatatatacatatatatatatatatatatatatatatatatatatatatatatttgtttcgctgtgttttgttttgttttcaagacagagtctcgctctgttgcccaggctggagtgcagtggcatgatcttggctcactgcaacctctgcctccagagttctagctattctcctacctcagcctcctgagtagctgggattacaggcacccgccaccacacccggctaatttttttgtatttttagtagagatggcgttttgccatgttggccaggctggtctcaaactcctgacctcaggtgatctgcctgccttggcctcccaaagtcagaacagtcttaattatccttatttatgggtgaggaaagtgaggtacagagaggttaaatggcttgcccaggattacacagtgtagtaggttttcaactctggtaaaacagctccagcacccataatgcaccacttcccagctcactgtccttgcgggaaaggtgcctgcttcctgttgacctgtgccctcgtgctctgcctcccctacttaccctttttcatacaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcaagtccccgttgtccctgctccagtcccagcgcagctctccgaagggcatggtccatcctgtgaatgtctgattcccagcccctagcccatcagaatgtagactcccaagccagttccaaacctgctgaatcagaatatcttaggagagtagaaggcattatgtttttttgtttttgtttttttgttttttttaaaaaaaagcttcccaggtaattgagatgctggcagcttgacattgttccctgggcctggggaccaacatttgagagaacagggtcactgctcacaggaccaggggccatgatgttctgttcctgatcagaaacactaccagtgtttgctggaatggggggaccagggggaaagatgacagcagacacttaagaaagggctctttttggcccttcctggggagccatgtggaatttcagggcctggtgtccatgttaaagcttatggcctcctggtcttcacttagaatgcagctggctcagtgatcatgctaactctggtatggtccatt

SEQ ID NO: 9706 - DNA, 1169 bp, Homo sapiens
cagctatttgtagctttgtgacagcttgacatgcagagatctaggcttatcaaggcactaagctaggagtcagttgtttgtatcactggaagattggttacaacttccttcattggaagctccttcagtgcatgttaaatgatgttatttatagatagggtggtgagaaagctgtctaggtagatgtcagtcagcccagtgtaagagagacctgcttactgtgggtgcttgggactatgtggagtgggtgggaggttttaacttgttcagtaaggtcctttccattgttcacaatctggtgaaccctttttctaacatgaggagcacccacataaccagatcatgtctggcttccctgtggcttgtgtacaaagcgtgcttattgagttaatgtgtaagcaggagacagccttctgtgctaaatggtatattaaccacttctcagtcttaccactctctttcaatttgtctcgacccaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggtgagtgggtgtgccccttcccccaaaaaagggcttcatgggcagtgacctttctctcctgaaaagagtaactaaatgtcctaacaaacctaggtgctacatgggatactacacagattcttatgaaaggactcaggtcataggaagttgcagtaaagaattagtatgtgcataggatggcaaatacagttaataagagagtattagacatttcaaaattgctaagatggcgaggtatggtggctcccagcactttgggaggccaacgtgggaggattgcctgagcctcgaaatttgagaccagcctgagcaacttagaccctgtctctccaaaaagtgaaaaaaaaaaaaaaaaaattagctgggcatggtggcatgcacctgtagttctggctacatgggaggctgagacaaagatcacttgagtccaggagattgaagttgcagtgagccatgatcacaccactgcactccagtctaggcaacagagcgagatcctgtcttaagaaaaaaaaattgtccg

SEQ ID NO: 9707 - DNA, 1202 bp, Homo sapiens
ccaactttccgttcagctcagtctccgagggtgcgccagagcagacacccggaggagtggggagtggcagggcggggccgggagaatgctgccccggaacccataaatctgggccctgcccaggtaggccgggacagctggggtggcctgggccgagagccaagaaaagacaccccatctggcagcccaacttggcggcaacaggtggcccggcgcccgggggtctgggaggaaagtcgctccgggggcgggccccgttgccccgccgcgtccccattggtcatcaggtttcttaaaatgtgactctgaatctgtgtccttccgccgcagaatttagtcccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggcgggtccgccggctcctttcccgccccagccctaccccctcattctggtcccatcctcttcctcctgccccaatcctcaatgcgcctccatcctcgcctgccttctctcggtccctcgtgattgattccacccttgcttcccctttctccgcgccgcctgttccgtgctcgttttcccctcttcctccttaagtctggtccttccaccccctcctcttcaagctgtgcgtgtcccctgattctaatgctttctgtgtaactcattgaaactgcgttctggttcccctcccgcgtccattctccattcatgcgcgaccgcccttcccgcgccccagttccctctcgccgcccctccccctgcttgctggtcacgtccgct

SEQ ID NO: 9708 - DNA, 1223 bp, Homo sapiens
tcatctgacaaatggaaataggaatagcaccactataagaattatgagttgatgcatataaaacactgagaacggtacatgggatatgggaagtactcaattatttctagatgacactagagagtatagtatatttatatgaatagaatgcttttatctcctatagtactgttattactatatatatgactaaaagtacttaaaatgatttgtctctcagccctacttaaaaagaaatcctaggaaggctgaagtggaaagatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaacaaaccaaatctagaactggcttttccttaatgttagtaatgcaacctagtgtagcattgacaccaactttatagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtaggttggggaaattaagggaagaatgtgtttacataagtatgtgccatgtattatgaataacatttctacctcatagatatcaccatctaacttgcaagctaaataaatacatagtgtgtgattaatgttataagtctatgcaagacatagagggattagttagatatatttcataaaggaggtaacaatttagatgaactttaaggggaccaagagttcattagttataaaagtagtaggaaaaacatttagggcaaaagttgcaacatgagcaaaggtagaatgttgtgaaaatacatgactttttcagagaataactgtattatcaaatgtgcctctctaggccaaaattgaaaactcagatgctgttggcaaaacccaacctgcaggtggttttactctgcatatcattagacattgtggaatgctttaaagccttgctaaaaggctttgtcatattttttctttaaataagcatatatatgttgctt

SEQ ID NO: 9709 - DNA, 1294 bp, Homo sapiens
tttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacac

SEQ ID NO: 9710 - DNA, 1934 bp, Homo sapiens
agatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatg

SEQ ID NO: 9711 - DNA, 1294 bp, Homo sapiens
aactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcaggaattctgtctgtaattgatttttgtctccatcaccactctggaaccagataagataaaaatcattctgatcttcatttgtgatgtgcatgttactttgctcttgaggtgcttgcagtccctcatgctgagcctgagctataggcttgtcctgtggggttgaaagtgacacaaagtactagtatgaagtagcccagttaaagctgaattggagcatagcagtttgagagcatggtgagccttttcagcttgttgggagggcagtatgaacatggcagctggtggtgggcctgcctagttcaggggtcttcatttcccctgggcccacagcagcttctggaatctcaaagctacctcaa

SEQ ID NO: 9712 - DNA, 1482 bp, Homo sapiens
tcaccgagtcttctcacattgatttatttgcccaagatcttgtagctatcaagtgccagaggagcaattgaagcctggtctttcccatttctggttccttgttgatgccatgttgttgccattaagagagatttaagaaaaacaagtttcagaagataaattggatttcagaggaggagaaatgtacatacattgttatgggatttcagatgaagcttctctgtcagctactgaaaatgagaagctggtttttaggaatatattgagaaacaggattgcaaattttggagacactggcacttaggttgaagccagagactggataggatcacccaggaagagaagaggagaaggtaaaaatggtaaaggtggaattctgggaggcactagcccttaaatgctagtgcattaaggggctggtgaaaaggggtcaaagaagtaaaggataggaggagttttaaggcgtttctaggaaacttcccctgcttctaaatcagactctggtacctattcattggtttaaaaatgatgaaacccggcaggcatggtggctcacgcctgtaatcccagcactttgggaggctgaggtgggtggatcacctgaggtcaggagttcgagaccagcttgaccaacatggagaaaccccatctctactaaaaataaaaaaattaggcgtggtgatgcatttctgtaatcccagcttctcaggaggctgaggcaggagaatcgcttcaacccaggaggcagaggttgcggtgagccgagatcgcgccgttgcattccagcctgggcaacaagagtgagactctatctcaaaaaaaaaaaaaaaaaaaaaccctcatgctaatatttattgcccctggaactggcttcaccctgaaccttgaaacatatcttggtcttctcccctgtatgaattctccattctagctagataattctttattgtatccaaacacaaggttaatcccttcatgtacaactttgcttgtgtatacttcctacgtgggtttcagtatcatcagataaatctgggtttgaatttcagctctgcctgtctgtgggctttggaatgttagttaatccatggcctcactcttctcagctgaaagcagtgatgactaattagcgatcttaccgcattttgcaaataggtttaatctatctgaaaatgcctgcctagcgtggggtgcttcttaaagatcagccgcctttcttctatctagatgcaggagctagggttcagcacagggaccactgccctagccatttttcccccgcctctttacagttctatgtcttaacaattacgattagctcttataacagctgatgcacataatgtaaagctagagaaaaccttagaaaacattttacaggtgatgaaacagaagggaggagataggaaacatcgtctttgccttagaggcacttatggtctagaagggagaactgtgccctctttgccagccccccaaccc

SEQ ID NO: 9713 - DNA, 1171 bp, Homo sapiens
ggggtctcggcagcgccgctattctgtgagcctattcctctcagaagcgccgagcactaggcctggaagaggacaagtctagcaaatgaggggacacgggcggagggagggattaaaagatgggggtgtgatccgtgccaatggggacacccactggttcgaatattaacgcgaggtttgtccgcttcttcacaatctgtccgtttcgttttactgcgaaagcaaatgtgttcccatccctctatttggggatacgattagagttccgggaagggggtgcagcgcccggactggcacaaccgccgttgtcccacctcctccggggcggcaacaccgcagtgccaggcctgggactgaggcgtggggtcccccctcgctccgtcctggcgccgcccgtcgccccgccccttggggggccccgtggcgcacccttgtgacgtagcgcttgtgtcgacatcggcgcgcgccgagcccggaagaggcgcgggctaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccggtaggaccagccctaacagcttcttgctaatcccgctttgtctgacacctttctccgagccttcttcctcgttccaacttttagccccttctcttctggcgactgttgttttgcaatcaaagatacttgaccttacccactatgacaacactcttcctctttcttctgaacttcttgaagacgcgtgatgtct

SEQ ID NO: 9714 - DNA, 2391 bp, Homo sapiens
cagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaactctggtctggtcaaagagttattttcctttgtccttaaaaaaaaaaaataacaacaactttggggccccctgcttcccagcctctaactgacttcacggttgccttcacaactgtaaagccagtagtctatgaggagactcagggaagggtggcaggtgagccaggaggctgcaggaggtgtttggaccgtccaccagtaccaaaaatgagtcttgtccctgttcccatccccctgttgctgccctgcagggactgagcagcctgaggaatcagagggggcccctggcagccgtccctgaatggagtgcaggccatgtccctgccgcggcagcgcattctgttagggcagactgactgtccacgtggggcctggcctccccactcccagc

SEQ ID NO: 9715 - DNA, 1138 bp, Homo sapiens
cacctgaggctagcgggctctaggattagatggtccacctctgcaacagcatagagatggaagagtctgtgcacacagtagctggagtcccctagctactttcttctggactttttgtgctaacaggaaagagtccacataggaactgcgatcctcttaactgtctttcccatccccctccctggggtgggctggttgcctttgaagtgctaaggttgagaaatgcctggttaagccacaattaacaaaattacaaggctgaggaaaagcaaaaactaaaatatgagccagtaaatgactcaagaacttgaaatagaattatctctatttgcaaagaaggaaataactattttatactaaaaaatatataggtactacaaaaatgacacacctgaatgtaagagagcagcaaaatgaccagaaccttggccatggcttgtgccgcttaagacggattctgagaaagagcacatgctaccaaaatttgtacaacagagttaagggcaaaccttatgttttgccattaggaaaactagaatgttctaggtggtgcctcacaaggtctgtaccctggtggaatttaatccaatggctttaacttatcatctgctctgcagcttcagacactgtcttatcatgccctctcttggctctggaggttctgatccttgctaattgactaggatgctgatttgttcatttgcaagggaaggcacatctgaaagggtaacattggtggcaataatagtaatgatggattttgtgattatatttgccaggcattgtattgggtactttctatacagcattttaatctcaccattttacagatggggctaattggcttccgtgagatcacacagctactaagaaatagggccaggattctaacctagatccattttgataccaaagcctgtagtctttgcacaacatcatgctatcttagtcaaatcacccaattacagttcagaagagtccctgaaaatagaatcaagaaaggcatgaaagtttcctaaccacttctcaggtattcctacctagacatttgggaccagtctttaacatcagagagctggagccttcatctggggctgtagctcacaactcagcctgcatttgttactgcatgttacaa

SEQ ID NO: 9716 - DNA, 1220 bp, Homo sapiens
tttcttacattcagaatgcagctagcacatagtaggctgctcacatccactctgccacctatgctgtggcgaagatgaactgagctagtggagctcattcattgatagcattgataggtttgttttcaatccacaggttatcagcacagtattcttcattaaagtagaatctcaactttgcaaacatttcatcagtacatttgaaattctttccttagggcaacaagattatctcacatgctatgtgtattcagaatacatattaatatacaaaattgtaaatgtaacagtaaaactatgtaaaggaagcctgtaaagctaattaacactaatttttttggtgtgtatttcgctaatctttccttaaagcactatttgcctgtgttctattagccaggtattgcttttacctgtaatctgtaacgacttttctggtatccctgcagactcttctggcatcggaggagctgccccatgtctatgaacaatctgcatggggtgcagaagagttaggccccttcctacgtttgtgccttatggatcagaatttcccagcatttgtggaagaggtagaaaaggaactgaaaaagctggcgggtttgagaaattaatgctctatatacatatataactaaggaacttcaaagtattgaaaaatgcttcctcctaaaattaaagaagatattagaataaagagtattatccaaacaccttttatcaatgttttatttttaaaaacaggtgaatccacttttttatacatcattgcacttcaataattacacaaaacacacaagtacatgcatctacaattacgcaccgcatgagaaccgttaggttataaaatctatcatcaaccagtaaatcaatgtgaaaaaatacagtgtcaaaccaaaaagtataactatagttgcatagaatattaccatgctataacatttcaaggtcattggaaacaaaagaaaaattataaaagtttgccttgattgaatgaatgtacaagaataaggttcaacacatcagtgcaaaaggatttatgaatttacatgacttaacagaagaaaagataatcacttaaaaagcaatcatacgtatatactgcaattcattatacccattcagtggactgttccagcttattaaagtcacaggttaagcccttaaaattatagatttcagtttatattactcatctttatgtaccagaactgcacaatttc

SEQ ID NO: 9717 - DNA, 1849 bp, Homo sapiens
ttgtgtcacatgtttatataaatgccatttcagaagacatattttaaaatcaacacttttcactactattatatctttacaaagaggtgaaaattgtcaccttcttaggtggcttattcccagaggcctactagtcttacctcacgtctgggggcaagacaagaatggccaggtagcagcagggccagaatgtcatcttgttaggcatatggagatcagaatttcacaccacatccctgagcgtgctgtttgaaccaaagttttgtgtggcacacggtgtagttgtgagtgacagtgcataatccctttataatttccaaatacatatttctttacagatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaggtgtttggataatactctttattctaatatcttctttaattttaggaggaagcatttttcaatactttgaagttccttagttatatatgtatatagagcattaatttctcaaacccgccagctttttcagttccttttctacctcttccacaaatgctgggaaattctgatccataaggcacaaacgtaggaaggggcctaactcttctgcaccccatgcagattgttcatagacatggggcagctcctccgatgccagaagagtctgcagggataccagaaaagtcgttacagattacaggtaaaagcaatacctggctaatagaacacaggcaaatagtgctttaaggaaagattagcgaaatacacaccaaaaaaattagtgttaattagctttacaggcttcctttacatagttttactgttacatttacaattttgtatattaatatgtattctgaatacacatagcatgtgag

SEQ ID NO: 9718 - DNA, 1073 bp, Homo sapiens
caggttcccagctggctccccatccccaccctataacatgaccggcgtacagaaattaattggccgactgttaccaccactagtctgtccctggctagactagacagatgggtgtgcccctgggctcagtggtagcctacccggggtgatggtggggttgccagctgtagtccagctgttctggggcctgtgtttgtgcacctgtggtgctgtatcctgccccacagagctggctgtccagtggagaatacaaagtgacatctggtgctccctcagaaagaatgtggccccagaggcatgccagtggctttagactctctgggaggacatgtttgagagcaacagccccttccccatcttttcctttcttctcagcagttataaatctctctgcctgcagtaagtagagtgagtggctggtgaggaggtttgttgatgacactgacaatatctggtgactccctccagatgtgcactcagcagtgagctgggcagaggcgtgggaaggacgttggctgggagcagacggcctctgcaaatgaatctctagtttcctgcaacctgggagtgtccccatgagttttactttcctactttatgaagtgaacctgctttctttgggatttcatgtactcctaatgctttttctctccaggtatttctttcctgctacatattaggactcccaaggcaagagtgcacctttatttagacctgggagtaaagggaaagagttgcctgtctttcgtgtgttttcagctttggctctgtgggatcagttatgcctcattcctgaaaagggcctttttatccccccagaatgcttttgctttgccaataccaccttcctcagcctgccttttggaaaggttgagaagctaaaaagtcaggtaagagaaggcagagatggacttcagaacctgatttttaaattttaaggcaaggctggctgccactggtgagagtgatgcagcagcctagcgtgttcccagcagaggtctagtctttgccctaagaagtcaccgcgcttatgaggttgctatcacagtgcatgtggtaggttagatttgaga

SEQ ID NO: 9719 - DNA, 1228 bp, Homo sapiens
aaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacggtaagcggggcgccgggggcgggccgggcgggggttgaggggcgccggggccggagggggcccggctctggcctgaggagacgctggagctcggggaagggggccgagtgggcgtctgaggggctgcgggtccgagaggaggtaccggctgcgggtttgaggaggcgcgggtgtgaggaccggaggctcctatccgagcggcgggggcgtccggggtgagcccgaggtgttgcccactcggaggctccacgtcgtggggctcgtcgtgccgggtcggcgaggggacacggaggaagccgacgtggggagctggagtagcgggggcggatgaggagggggcgcagctcttagggagggtggcacaagaccggcgtttgtgttccgggcgacggggatggtggtgtccgtcaggccccccgggagctggggtcgtccaggattctactgaggccccgtaggactggtgacatccttaaaaataagggggaaattggggggaagagagtcctgaggaacactaatggtgagctgagtactagagaccaaaggagggggtaaagaatcagggaaccttggatctagggatagagggaaggtgggtgggaagatgagggagtgggttgactgcagtaggggacctggagagagaagcagcagtgtctccaaatgagctgggggaagagggctgggtttgctaaagagggtggagtgctgggcattctagggtagtggttgggagagcaaaaaggagtttctaaataaggagaggaaaatgagcagaggatggagggaaagggttggaactgaggtgggggaatatttattagagaagtaaggaggcctgggtatagagatgggggtgggggaagacgaaaaataagggaagggagtaaaatgcaggaagtcgggggtgtaatgttggtttgcagtgtggaggataaattagggaaggg

SEQ ID NO: 9720 - DNA, 1333 bp, Homo sapiens
atgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctttttctctgtgaagtgtttggaagcagggtgggccccaggactcaaccagcaggattctctcctggatgttgcaggctggggtagggaagcctggccctccttatctcaccgtccttaaatcactggatccccaaggccatttggctccctccttggcttcagtttccctctgggtaaagtgaagttggttgtccagaaagccaggccctttggtcactgtatggggctcctcccactggaagcatcactcaatttctttgcctcagaaaactcaaacctaggcttgtttagggcctctactaatgaacccattttagagactgtgaagctgagacccagtaagaagctggcaccaggaaaagagttctgaatgctgtttctggctgactcaattggatgggcaccaggccagggatcagaggtccattc

SEQ ID NO: 9721 - DNA, 2062 bp, Homo sapiens
tccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaagcctgatgctccaatcacagactctgctcagcatccccagaggaaccactgagaagccttttgcctggataggagggggctctcccaggcataggcttgtggccacttgcccagcacaactgtgttttgtggggcgtcttttaggacttagcagagctgagagccctttgttgctcaatgctgtgagccttaagcatgtgaatccccccacatgacaagtggggagacccagggtaggctttcctttggatcatctccaaatgggagtgccatgtggcaggaaagaagcaccgatttcaagaattacttcctagagaaagtcaggaactagagaccagagtctgcaggaactttgccactgcccttcactggctaatcctgtacttctctctgtgttccttgagtgacaggtggtaaaacccttaaaaagggaggtgtgggaggcccaggactttggtaacaggtgatgaatgtgttgtcttggccatcacaggtggagcttcagttagtacccgagggattcccctggcacaagcatt

SEQ ID NO: 9722 - DNA, 1166 bp, Homo sapiens
tttgtaaaagcgaaaaatttaaaacatctcttacagtccacaaatagatatacctactatataccacaaaaatttaagacatttaaaaaaaggtgaaaatttctgcgtggcaaaccaaaccaaacaaaaaaccgaagcaaagtccaaaggctaacaaactgggaaaaaaatctgtaacactcatcacataaagagcaaaatcttgctgttgtgtgtgtacacatagcaagagaaagaaagtaatttagcctcttggaattcagacagtgaataatttgtacattctcttttgatccttatgccaagaatttcctttttttattgtaaaactttggatttgttctcttaaccctcaagcctatcttttagtcttcctagaagcaccgtgttctgtggaactcagcatcagcagctttgctgaggactcccccatcttcctttccttccccggaaagcacagacctaagtgagtcttcactggatcccagctaacagcttctgcccattcctatctttccacagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctcctgctttgtccagttcttgacctttctggctgatctgagttggtggaggcagtggggcaaacaaggtgtgctggtcttgatgctgtggcatcaaagcagggctggcccctagttctgggccctggatggaggatgttagaccctacatcatgggatgctgtgagatacccatgttaacttctgggagaagtttccagccgtagcccccagactctctggggctttggagtttgggagcctcaggatgtgccgaagtctaggcagagctatcacccaatcttcagggtggctgctggattacagctgtgcccagaagaggcttatgcttccgagatgtccagtctatggagtggctgggtggactttcaggggaagcacatggaggcagcttgc

SEQ ID NO: 9723 - DNA, 1095 bp, Homo sapiens
tgaaatgtatttaattggctaggcatggtggttcacgcctgtcatcccagcactttgtgaggctaaggcaggaggatcccttgagcccaggagttaagagactagtctaggcaacatggcaaaaccccgtctctacaaaaaactacaaaaattagctgggtgtggtggcatgtgcctgtagtcccagctactcaggaggctaaggtgggagaattgcttgaccccaggaggttgaggctgcagtgaaccgtgatggtgccattgcactcaagcctgggcaacagagtaagaccctgttttccaaaaaaaaaaaagtatttgttaagttattgaataagagtatcttttaaaacatgtatcattctccagctatctaatcaaaataaggttctcgggacaaaaaccatgtaaatttgttttgaggagcaaaatataagtggacagttctttttttagatctgatctactgtggtcggaagctaaaagatgaccagacacttgacttctatggcattcaacctgggtccactgtccatgttctgcgaaagtcctggcctgaacctgatcagaaaccgggtgagtgaggggcagcccttaggcaggcagagtttctgtaatatccgcaagggaaggatctgtgtgttcttgaggcacaagcctgggtggaacaaagggatgatttactgagctgatgataaatgatatctttattacttattggattagaccatgctgataaacagagtccaattttgaccttcttactgccggcatcactaatggaagatttgtttctccattttgttttttgttttttggtttttttgagacagtctcactctgttgcccaggctggagtgcagtggcacaatcttgatcttggatcactgcaacctccgcctcccaggttcaagtgattctcatgcctcagcctcccgagtagctgggattacaggcatgagtcaccatgcccagctaattttttttttttttttttttctgagacggagtctcactctgtctcacaggctggagtgcagtggtgtgatcttggctcactgcaagctccgcctcccgggttcacaccattctcct

SEQ ID NO: 9724 - DNA, 1647 bp, Homo sapiens
ttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaactgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaagcaggtctctctcagttgctttgagtggcctttccactggacagtactggggagaggtgagctccttcagagtgaaaggggactgagtgaactactcctgaccccttgatttctcctgaaccttctc

SEQ ID NO: 9725 - DNA, 3161 bp, Homo sapiens
cctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactgagtcctgtgccgtgtgacttgctctgtaggctgtcatgaggtgctgtctgtcccagcctaggaacccgccccactcgtctcctgccctcagcaggccatagttgttgggcacatacagcctaaagtcctggccagtaatgggactggcaggctgtggaaaaccagaccccacctggctagccacggtgggctgattcccttaggttctctggggctgagaggtacagaagccagcagggcagaggtgccatctaggactgctcagcagcctgggcccagaggatgtccccaattctggtcttacccctgcctagctcttctgtgcctggcccagttcacacttagctctccacaagctgaactgctaagaaagactttattaataaggtcaggtaaggggaaggcaaggagcctggagatggacacactggtaccaggggttacaaacagtaagaaacactttattataactttataacatataaatagcttgggtcaaatctgtgctttctggcagctgggcaccaagtctgctcccctgcaggctcctgccttccttcacattgcactgttcattgggtggctctggcctggggcctggcggtcgaggctggagtcaaggggctgggcggcccagtcccgccctccatctcctcatgcggtggcctgtgcctgtcatctgcttgggttgcggctggtgtggaaggaccgctcctcaggggtcaggccagcaaagaaggggtgcagcagggcctcggccagtgtgatgcgctgggcagggtcaaattctaacatcctcctcatcaggtcaaacagctgcacgtgctccagggagtcttggagcatgtaactctgctcagggacacaaggtgcctcagtgtgacggcagggtcgtgggaagccacagcaggtccccttgcctctgggacgccttgctggactggatcgaggaggcagtgatgcctccttggaggactctacttccgccctcctggacaatgagcagctcctttcctttcatgcctgtttaacgttttgctcggaacttgccaggctactaggtgtcttgctgggttgatgcctctgcccccacatgcaaagtcctgacaggtgggtagagatcacctctgcgaaattcacttgtccgagcaccaaatgcagttgacagaggcttcctggccatgtctaggtcttccctccccctcacctcagtcctgcctagttcttcccaaaatttcgaggagagagagggacag

SEQ ID NO: 9726 - DNA, 1185 bp, Homo sapiens
cacgggttcgaattctcccaggagccactgtcagaacccaaattggaagggagtgcatgagggaggtactgccctgcagctccacggactcgtcttctcgggtcatcccgagtccccccctctgtggagctcagagtaggaggtggctggagtctggaggaagaggatccgtatgggccaggtccctagagagagtgctggactcccctgcccttccctgtacagggcctccccgcaggtgccctggcttgcttggttctgacccctccctcattaccccaccatgaccctgcgggctgcaagcaagcccagggcccagccacctcgggtgagcagttagaagcccaggtcctaggactgagcctgtcacccttggcctctcagaagaccaggcctaagccaagggatctttgggtgggaaactgggcaggccttctgcccggggggaggtaacggagcattagcaccatgcccccaccttctggcaccctgggcagcccattctcctaggctctttgtggcccagaccaggtgtcaggaaggggtgtgtccagccagcagattttttggagcttaactaccagttcacttccccgcccattttgtacacccgggaaccgaggctcaaagggagaagttgctaccccaggcctctagtggagttaggctggctgtcctttcatccccagctatacagggctggatggctgtgggtggaaggaaaccaggcaggcaccttcacccactggggacacaggcccccagcccggccccagagggaccttgttggttgagcacgtgcttccctgcagagggctggagggagtgaaagggcttccggctccagctgtggctgggtcagctagcaggagatgtggggaatgtgtggtgtatggccatctgtgtggtgtggcaggaaggtccggtcctggccccggctctgagttgaaacaacctggtggtcagtcctgacccagcactcgccacacctatggcccagctggcacaggagcagccaagttcaggatataaatggggtcacatgggaaccgtggaagctctgtctccactggcagcaggctacagactggggacatgggagcattgtgagagtggggacacccagggggcctgtttcaagctcctagtaccctggcggttccagtgtctttcttggttgtggcc

SEQ ID NO: 9727 - DNA, 1250 bp, Homo sapiens
catgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgagcctgcttgtcctgcccggtcgtccctcccatgccatcttgtccatccccctgtgtctgtgagtggggctgggtggggagcatggctgggagatgtagccgccgctttgtgtcagctgcacgagtgagtgtccttgtgtctgccctccgggaagtgctcaccagttgccctgctgccgccaggcccagctccggggccccatctacaggatgctgcctgggggttccagctgcctcccctgctgttttcaagcctgccgcacaaggagggctacagctagggatgggagggagcccaggcctgcacagatgggaacggggttctagtcaagccccctgtgcaagagagagaaaaagcaatggtgggcccagtgggcttcctctggcaggaggagaagtgtctcatgcctgagaagatgctgacccggagagggacgggaaagctcctggtggttctccagtttcacccacgatgtcacagctttgccctgtcccca

SEQ ID NO: 9728 - DNA, 1157 bp, Homo sapiens
tgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttg

SEQ ID NO: 9729 - DNA, 1162 bp, Homo sapiens
gaagtgcaatgaagcgatctcggcccactccaacctccgcctcccggttgaagagattctcgtgccttagcctcccgagtagctgggactgcaggcatgggccaccacaccaggctaattttttgtattttagtggagacggggtttcaccgtgttgcccagggtggtcttgaacttctatgctcaggcaatccattcgcctcggctttccaaagggctagcgttacaggcatgagtcaccgtgtccggcccaaaaaaaatttcttttgttaaatggcagctactggacacttttctgattgggaaggaagtaccagtgtataaacaacaaaaaagccacaaagctagtcgcttgtgggttgacagtaggcaggattaagtaagagcagtaaagggtacagagagacagtgatttccctggttgtagcactaagggttatttttaaaagatttctactttttctttattctttcctggctaattctttgtgttttctcttacagatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgtaaatttggaggcattctgattaaacagctgagtaaaacaaatcctgc

SEQ ID NO: 9730 - DNA, 2090 bp, Homo sapiens
ccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgccctcccgggctggccctggcctcagaggctgttgcaaatgggggcccgtgtacccctgtacatcgccactaagggaaagggagcggcacattgttttt

SEQ ID NO: 9731 - DNA, 2941 bp, Homo sapiens
tcctacagaggcattcatggggagggagcactgttttttttttacagatgggtcccatctatttcctggatgggctgccttttctctttgattaacccttctttacgctctttttcctacaggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgtgttctgctgtgtcatgtgtcttcctgtggacttgcgtggagcctcacagcgggctgtggggcaggggcatgaaagtatggggggtgggtggatctgtggtctgtcattccc

SEQ ID NO: 9732 - DNA, 1408 bp, Homo sapiens
acagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccac

SEQ ID NO: 9733 - DNA, 1260 bp, Homo sapiens
gtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaagtggggcctgtccgtgtgtttggggatggtcggtttcatgttccgtcactgtgtgcttagccctttgctcgcaggctgctctccctgctcccagtccagaaggtgcttctgcaccctcgtgcagatggctgtggctctgtggacccctctcacacacatacttgcttgctctgggaaagccctctctcctgagaccccgtgggtcctcgtggttgttggtctgtgggc

SEQ ID NO: 9734 - DNA, 1339 bp, Homo sapiens
cagagcaagactcgtctcaaaaaaaaaaaaaaaaaaaaaaaaaaaaaaaaaaaattaaataaaaataatgtcctctacgctcctgtgagtaacttggctccgggggctccgctcgcctgcccccacgccgcccgccacccaggaccgcgccgccggcctctgccgcgaacaaacccttctgacggccctcgctgtgcaggccaggatgcctctcccccatccgcccccgctgcggaaagttaagtttgaagaggggggaagaggggaacatggacatgaagaggaggatccacctggagctgaggaactggaccccgtcagctgttcgagaacttgtcttggacaattgcaaatcaaatgatggaaaaattgagggcttaacagctgaatttgtgaacttagagttccttagtttaataaatgtaggcttgatctcagtttcaaatcttcccaagctgcctaaattgaaaaagcttgaactcagtgaaaatagaatctttggaggtctggacatgttagctgaaaagcttccaaatctcacacgtctaaacttaagtggaaataaactgaaagatatcagcaccttggaacctttgaaaaagttagaatgtctgaaaagcctggacctctttaactgtgaggttactaacatgaatgactactgagagtgtcttcaagctcctgccccagcttacctacatggatggctatgaccaagaggaccaggaggaacctgactcagatgctgaggtggatggtgtggatgaagagtaggagggcgaagaagaagacgaagaagacgaggaggatgaagatggtgaagaagaggagtttgatgaagaagatgaaaatgtagaaggagatgacgaagatgaagtcagtgaggaggaagaagaatttggacttgaagaagatgaagatgaggatgaggatgaaggaggaggaagaaggcaggaaaggtaaaaagaggaagagagaaacggatgatgaaggagaagatgattaagaccccagatgacctgcagaaacagaactgtttagtatcggttggactgctcatggatttggtagctgttaaaaaaaaaaaaaaaaaggtagctgatacaaaccccaggacacccacccacccaaagagccaaagaatagttcctgtgacattccgtcttcctccatgtagtccctcttggtaatctaccaatctaccatcgagcttagggacttcaccccaacaaaattgtaagtgttgttaggtttttgtgtgagactcttgctgtagcgtagatagctgtgattggtgagtcaaccatctgtggctaccagttacactgggactgtaaca

SEQ ID NO: 9735 - DNA, 1071 bp, Homo sapiens
ccggagagacttccctaccaggaggcagtccagcgggacttccgccccgcgcaggtcggcgacagcttcggacccacgtaggtaacgcccagcgggtgggcggggccacaggcctaggggaagtcccaacccagctcccagccacaccttcgttgtctgccctctgccgtagacaactacgtgggatcgagcagcaccctctgctgggagcagcaccctctgctgggaacagctctctggtccctgggtcttcaggggatggttttcattcccacgtggccgcctctggacatcccttaggaagggcaccctagggatcacgaacctttgacgcctctgcctgtttccctcatcttgcttctcaccttgttgctcctttcttgtgactcaaagctgagtaccttgtgacactgcagatgcttggagagtttcaagcccctgccgacactttatccaaggaaggatatcaggataggacttctacctctaggcctatcacaacagctctcttgcagatggtggacctgctggttccgggtggagctgaccatcccagaggcatgggtgggccaggaagttcacctttgctgggaaagtgatggagaaggtctggtgtggcgtgatggagaacctgtccaggtgaggaaccctgtcctagggccaggtatggccacatttcagccctgaaatgactacagcccttcttctgtggactctggagaagccacagctgagttgctctgcccacagggtggtatcaggatttcaggactagggaagttgccacttgggcatctgtgcaattggtccttagtttttattgtgtataatacaaacttataggaaaacatttcaaacagttctagataaagtaatggatctctccttatcacccatcccattccccagctataaccactgttaagtgtcttattcatgctccacccttatcaggtttagtccttatactcctatctagtaggtctttatacccatttacaaattaagaaacagatgtgtagttgactcactcaggttcacacagcttctatttcaaattggactgactct

SEQ ID NO: 9736 - DNA, 1208 bp, Homo sapiens
tgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaacttttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatatt

SEQ ID NO: 9737 - DNA, 1106 bp, Homo sapiens
agtatttgaatatatttaaatatttcaagttaaaccaaaaaactctcaagacaaagcggtcttttgggattgttttgattgttattgtttgttcataatggatcttagcaattcaggaaagttcagggaaacgtttcagtaaagtcatctcctgtttggttcctctggtctaaaatcagtagtcctaagcaaagcacacggtggtggtggcggcagcagcgacggtggtggtaataactaccatttatccaacttcatcctgtggttcttatgtgccaggtattgtgctaaatactttatgtggattgtatcatttaatccagacacagggttgtgagagtaataggtgctgttatccctattttgctgataaagaaacagtcttatgtagctagtagggcagaaccaggattcaaatccaaggagtttgactccctaccttattcttctaaacactactctattctattttgatttgggtcctgagcatacccttctttgtcttcctcttcagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggtacatgagcaaatgtgcccttagtgctttagtgtacttcactaccggttcagtgtctcattaaataaggctctcattttcaacctggttgtcccatgagacctctctttctccccaaccctggttgttggaattcaggtgcagaatggaacttcttttgggggtcctgtgtaaccaacattagagaacaaatcttgtaagttcatggtggaaggctctgtgtgtatgtttgggggagtattttaaaatacagaaaagaaaagaagataattaccacccatgttcctgccacactcaggactaactgttgttaacatctttgtggtttgtttgtttttgttttgttttgtttt

SEQ ID NO: 9738 - DNA, 1132 bp, Homo sapiens
gctcactgtaacctccacctcccgggttcacgcaatcctcctgcctcagcctcccgagtagctgggattacaggcgcccaccaccacacccagctaatttttgtatgtttagtagagacagggtttcactatgttggccaggctgtctcgaactcctgacctcaggtgatccgcctgccttggcctcccaaagtgttgggattacaagcgtgagccactgcacccagtcctgtaatggcattttcttagtactttttcttaaacatatatactatatctagatgaaatgtctggaatttgctttaaaatgcagtggtaggagaagtaagtatagatgaaacaaaatttactatagatcattgaggttggggtgagtacataggttcgttatacttctgtctacttttgtgtatgtttaaaagctaataaaaagtaaaggtaaatagggtatacagtataaaaggtacagtgttcttttatctttagctttaaaagtctagattctatatagtgtctactgatgaatagttaagaaaagcatacggaagtctggagcaggggttgctgataagccacttggtttggtggcagtctgtggtcttcaccaaaggatcacagtgctaaatacttattttggaactgaaactccagattggtaatctagctagactagttttactttgtctatgccattgatcatttttgggtttttggtattaagatgctcaatattgtaaatagaggaagaaaaaagaccagatcagaggacagaactatcttaagagagcgttattccagattaccagagtttaaaacagccttggcaaagattcttgctgtaaacatgttaagagaggcaacaggccggacgcagtggctcacgcctgtaatcccagcactttgagaggccgaggtgggtggatcacctgaagtcaggagttcaagaccagcctggccaacatggtgaaaccccgtctctactaaaaatacaaaaaaaacattagctgggcgttgtggcaggtgcctataatcccagctactcgggaggccgaggcaggagaatcgcttgaacccgggaggcagaggttgcagtgagctgagatcgcgccattgcactccagccaggacaaca

SEQ ID NO: 9739 - DNA, 1115 bp, Homo sapiens
ctccaatgagacaggaagagcttccctgcttcctccaatagtgttggggctcgggggtgggcttcagcagtccgtctccaataggcggggttgagttagggaagctccccgccaataggggcgtggagaaggagagcggctccccctcccctaccagtcgagggggaaggggcgggaaaatcataagacaggcctcggtggttggctgagtctttgacgggcgggtattgcgtcctgtattggaacgaagctgagtcttccctctgcggggcggggtcgggggagtgggcgggatttcccgggtaacagagaagcggccgcggcggtagaggcggcggagacggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggtgagagcacgctgggccgggggccgggcgggagcctggtggcgggtaacgccggactcgagggtgtgtattttggggggggggggctgacctcctcggcttcccgtagagcagacgggcgggaggtgtgtggttgtgtgaggggggtggggggcggagcggggtagctctccgcgcgggagggggaggagagcgtagtcccggtgcgcgcggaggggggcgggctctcgcgccgccgctcagaggcggggccggcgcgcgcgtgcgattgtggagaaaggggcggggccggcttcgcgctgagtgcagtttgcggccgaccaccccctcccctcctcctggggtgggcggggcctcgggctggcggccgcgctctggcctgctggggtcggggaggggtaggggggggtctcccgcgtgtagattcagggcgcggcagggagggggcgtgaagtctgagttcctccgccttcttgggatccggttggccggaggggccgtactgatccgtgatgccactccccttggccgtccccccctgca

SEQ ID NO: 9740 - DNA, 1507 bp, Homo sapiens
cgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctt

SEQ ID NO: 9741 - DNA, 1706 bp, Homo sapiens
cctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccagggaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaactttttaatctgtctggttttctttttttctctagagacggagtcttgctctgtcacccaggctggagtgcagtggcgcgatctcggctcactgcaacctccgcctcccgggttcaagcaattttcctgcctcagcctcccgagtagctaggagtataggcgcccgccaccgcgcccggctaatttttgtggttttagtagagtcagggtttcaccatgttggccaggctggtctggaactcctgaactcgtgatccgcccgcctcggcctcccaaagtgctgggattacaggcatgagcaaactgcgcccagcctctggttttcttacatagagtcatatttatacgtcccaggagcccagagaagaatagagtcagcagcgagtgacctgcctgtggattagatgtgcaacagggccacatgtggaggatgcaggatgttgtacaggattgggcaaatttgtcactttaccagtcccttccttggaatgagtgttttggcagagctcttcctcacataacttcctgttgatattccagccccaggaaataccgtattagagggctgggatgtttgcttgcctaaggaaataatcactctgtagcttggccatctagcggttagaagtggcccaggaggttcctggaaatttagatgatagcagtgatagagaataagaagggagactaccaagttttactcaagatttctttattcttttttctttttgttttttttttcacacaaggcccaagctggagtgcagtggagctgtcacagctcactgcagcctcgatctcctgggctcaagcagtcctcc

SEQ ID NO: 9742 - DNA, 1184 bp, Homo sapiens
cccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatg

SEQ ID NO: 9743 - DNA, 1206 bp, Homo sapiens
tgctgcggcgagtgccgcggctcctccgtagacccgcggagcaccttcgtgttgagtaacctggcggaggtggtggagcgtgtgctcaccttcctgcccgccaaggcgttgctgcgggtggcctggtgaggagaggaggcggaggcgggaagcttgcctggggacacgccgtgggcatgtcccaggctggcggggtggggggagagacccttgggacccaccagggccgtccccggctcgctcgccctacctgaggtgaccccctacccgcgaggtatctcccagccgtggtgccccggggggacttccctgaggggcgaagttccccttaaggttttctccatatctggctcttcttccgaactagcgccctgactgacacctacctaccccggggactttggatcccgcagggatctcctgctgctgcgccagcgggtgggggtttgtgagctgtgggagagacgaaaatgaacgtccgttcgcaatcctttgtgcgtttgcgtcctcagcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgaggcaagtagcaaggggtgtcatgcacagtcatttgcaggttggtggttcagtctttgagaactatttttttttaaatcccagttttgttaattaaaggaacatctcgttccgtgaaaagattttgtaaacatcagttttagtgactacacggtaaggatgtgtcatgatttatttgaccgttcatcaaatgttgggcctttttttttttttttgagacgtagtctcgctctgtggcccaggctggagtgcagtggcgcgatctcggctcaccgcaagctccgcctcccgggttcacgccattctcctgcctcagcctcccgagtagctgggactacaggcgcccgccaccatgcccagctaattttttgtatttttagtagagatggggtttcaccgtgttagccagaatggtctcgatctcctgacctcgtgatccgcccgcctcggcctcccaaagtgctgggattacaggcgtgagccaccgcgcccggcatgttgggccttttaagtatccacattttcactattaacaacaacgctgtgcagaaccttccc

SEQ ID NO: 9744 - DNA, 1198 bp, Homo sapiens
aggaccagacttttaatacttgttcaggagtaagaaacctgaggcctaaaagcttgctgagggttattctgctggtttgtggcagagttgccactaagacctaaatctgttttttgttttgtttggttttttttttttttgagacagagtctcgcctgtcgcccaggctggattgcagtggcccgatcttggctcagtgcaacctccaccttcctagttcaagtgattgtcctgcctcagcctcctgagtagttgggactacaggcgcatgcagccatacccggttactttttgtatttttagtagagatggggtttcaccatgttggacaggctggtctcaccctggcctcaggcaatccacccaccgtggcctcccaaagtgctgatattacaggcgtgagccactgtgccttgcccgtaaatctctttttctgtctcctttactcactataccaggcatcacagattcagatgactcgaaggtcaggcaggtagctgaagagggtcaggtagctcaatagtcgtagcaccatggcagtctggaaaggcttgcctccgtttagccttagttaagaggcacgtagtctaagtgttgccaaaatgtccagtttttaaaaagaatctggaaatccacattttatgtaaaaattcggtggaattttgaacattggcattcagtttacattttctgaaaatgctgtgtggaccaaggaaactatatccgtaggtcttgggcagccctgggccccacaggccatcatgctatctgtctcttttattagtttatctatgtagaatgtattctgaaacatcttggcattccctcaaattataatggaccaactttttttttccatttaactaacaatgaggctttgctatatcctaagtacttcattttattctggtagtaaaaaatatttgaaaatagctagcttggaaaaatatatcatccttttcatttaattcagctgctttgccgcttgtcttcaattggaaagtttagttgaaaacaggtgagtctgaataagcccagctcataggggagataggggacaaataagattaactaggggtaagggatgttgcatctgaggtccagagtactgagggagtttaggaaaaggttttggagaggaggtggcacttaaggtgtctctagagggaaacagtcttaagttccacaagaacagagc

SEQ ID NO: 9745 - DNA, 1100 bp, Homo sapiens
cacactataagtggttagcgccttttctctcctttaaaaaataaaaaatctgtaaattctcactgctgctagcacagctctgtgtaaaccagtgtttttttttttttgttccctactgagagccagcttgcaccttggtctaccaagagttgctgctcagtacatagctgcttcattatttgtgttgattgcattatttattaacacaaatagccatttagtttttttaatagaaaaaataattaagattttgcataatgtttgtaaaaaatggaaaacttgatacagagatcgaagaggatataaaataagataaaaaataaaaaatggaaaatttgatagcttaagccactaaattgcccttaaggtggagtgcaagtcagtaacatttcattttgcagcatgtataaaataatttctgttttaaggctgtctttaactgttgctcttcatttctctgcaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtatgtcttgtgtgcttctgatttcgtctgtgaatgaagggaaatggtctcaggttttgtcactttggggttaacaatttaaaaaacgtgtttaaagaattattaagataatagttcattccattttgtagtagacattggctaaggggcttactgaacataattctgcttacggttgaataattacatttttatatatattgtccttcaagaacttccttgagtcacattctccttaaaatttgacattgcctgttgatctttcctttgacagatgtggtactctgtgtgacctcaatgtgtcacctcctttctagtttcctcctttaaaggaaacacatggttagagtgtatctttatggcaaaacttctcagagcttctaatatgcccagtgctgtggaaatctggaaggagaatagcattacctgtgacagttcccaaatgtgtttggtcacaaaacttttttccac

SEQ ID NO: 9746 - DNA, 1189 bp, Homo sapiens
ttcatgagatattgccacttttctaaattttccaggaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgt

SEQ ID NO: 9747 - DNA, 1196 bp, Homo sapiens
ctcctggcctcaggtgatcctcagcctcccaaagtgctgggattacaggtgtcagccactgtacctggccttactcttttttttatacaatatcaatttaaacaaaaggtgaaatgtctgctgtgaatttttttcttttatatacattaagtaaatgtatacaagcataatctttttcagtatttgagaattttaccacccttctaaatttgttctatcttttcttatctaaattcaataatccacaactgtcacacttggtaattgatgtttattaaatttcatatctcatagttcaatatattgcattaaggtggcttaatactgtaaaactcatgaaactcttaatgtagttagagtaatggtaagtactcaatctcaaaggctatttaaaaagctgtgcttgaagttgtgtatccaaaggtgcacacgaaatataaaatatttgaattaaaatttctacagaatatgcatttagaatatgtcattactgatcatttatagtcttccatcactatgtatgtgtgttaactcactgcttattttgcttttagaaccttttgcccagagtagcagccaaacttgaggttgccccgatttctgacatcattgcaatcaagtcacctgacacatttgtgagaactatttatgcaggtgagtactcaaggaagataattaatcaacatgttaaattttagtgaaaagcataaattaatcttgaagatagaattttaaatcaaaccatacaattgctttaagtggaccatcttaaaggtttctgaggaaaattttagtctagaattgctggtggcccttgacatggcattctctctgatggatcgcaaacacagagatttcctgcctgtttattcagtttgcagggtgatattttcctagtgatcaataaaaattagattcacaatttaatatattttgtaagtggtacctggaaaagcaaaacttaaaaaaaaatagtattctcaatctttgctgcttctacttcatttccataggcattaagaaattcattttagccagctgcagtggctcgtgcctataatcccagcactttggcaggctgaggtgggaggattacttgaactcaggagtttgaggctatcctgggcaacataataagaccctatctcaaaaataaataaataaaataaattagctaggcatgttggcatatgcct

SEQ ID NO: 9748 - DNA, 1268 bp, Homo sapiens
gtaacatttttagatacttaaacaataatgagtacttgtacacctggatgattttgacaagtcaaatcacattaaattgtgaacatcttgctgaaaatacttattacacttgacacttttttgttttattttgaaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtatatgtttgtttgcttttctttaactttcagataaatattgaatttagcataggttttgtggtattgtacattatcttgcctcatccattcctttatgtggatagttcccaaaactgtcaaattattcttgctgcattttcttattttttttttaaataagagaatcatgttataatataattgaatgtgcacctgacacattttaataattggtgttgtagcaaatgtggttttgctctttggggctataaataatcttgagtaacgcaggttggaattaccaatagagctggtcag

SEQ ID NO: 9749 - DNA, 1659 bp, Homo sapiens
catcgctgcagaaagttctttcggacagcactcgctagactagtagtggggatgccaaataagagagacttgattccctgctggctttacgaagagttcctgggagggaagctgaagcttaggacttagttccttaaaaaataatgtactcataagaaattccttctatcactgttgttactgcctttttgatgatttgaagtcattgaactttgaaacagctcttttaccaacaaagaaatacacacctgccatgagagggttttcagccttttttccccattgttgttttctttcaacagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaacatattatttttcattatttgggggatatttcagttccagagcagcagtatcatgttttctttgttggtgctgtctatagttcatcatggtttacgtgtgttttcgttatagctgttgccagattctaaagggcttgatattcaaaaaaccacagatgctttcagtccagtatatcctagaaatatagagctctactttgtgcaatgcactggggatacagtggcgatactgtccttgtcttcaaggagttcggagtcctagtataggagacatacataggagaagataattttcacactgcagtggttgtagtaatagaatgggagtccaaaggggagttccggagaggtcaggggtgacttcctggaggagatgcccaagcttggaggctggataggctttgttgaaagatggtacacaagagtgtgaaacaaaattgtgtgtgcagggagctta

SEQ ID NO: 9750 - DNA, 1168 bp, Homo sapiens
gtattttcttttccttgaggtggggtagatagagattagaagtgtagattctggagtcagattgcctgagttcaaatccaagctctgtcatttctaccaaatttccccacttattgagggcaactgtagtgagcaaagatccccctaccaccatactgatccgtattggatgtggaattgagctacagtaagcctttagggatgtgtaggtgtgtgtcatcatcattgttattatttggttatggtttcttggtcctagctgaaccatcaattcgtgaaaagtaggtgaagtgtggataactttttaattttatctagtatagaaatgctcttaacaaggaatcatagaattttcagctttactgaaaaaagtctataacagttacggtaactctcattaaattataccatactaagcaataataggaaatttttaccagcagtgcttagagaccagtactgactttgttttctacagggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacggtaagatgtgttgtgagaacatgcaggagtatttagtctatgctactctccttgaacatgagactccttggctcttatagttggaacagagttaacatttaaacttctagcaattatctctgataactttttttaaatcaagagtgtatttaaagttattttttcatttgtatataattttaaaccatgttttcttacagtttgtcatcatcctgctcttggtttttgtcacagaagttgttgtagtggttttgggatatgtttacagagcaaaggtatgttgtctactgtaattcacataatgccttaaaaggtggtttaagtgtttcaagtaaaatagaacacattcattttatcagagtaaacattttcttttgccttacttgtttaatctgtatttcaaatatctaaagttaattggcaaatatttacatgtcaagactccttacctcatttaatatagcagagtgttatatatgtattgttcttgattatagg

SEQ ID NO: 9751 - DNA, 1145 bp, Homo sapiens
ttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctg

SEQ ID NO: 9752 - DNA, 1120 bp, Homo sapiens
ttcttgaagggacagcttctttggtatgaactcagccagtgagctgtgtccatttcctccataattctggatatcacctatctttttagcaccaagtatttattctcactagcagtagacagacttaaccagtctctaccacgacccagtagactctgacaacagactcttcctttaaggtgtcaacaactgacttactaggcaggactgccatccttagcatcagcccagttttggttaccagggactatatcttttgttccaggagagagtagaaagaaaaggagagatcccatccttgggtcatagacccattttcattgccattatctgtaagtatgtgcactgcatggaggacagccctaatagtctcccctctgctgccactgcctgattctccactctgtccccacttgccagtgaagtttggatttatcagccacttgtggcccattacagagctgacccaaggtggtgtcaccaatgcctcagcagggtggagtgcagttcagagcttataaatagctggcagggcatgaggagatgattttcttgcatgtgcaattctctaggggccatcaggaaacagagtttaaagtaccctttgattactgtcagaactgtcagcatttgcagttttccccgagcagtaattggccagctcccttctatcagtagccagtgttaactagtttaccaaatgctgtaaacaattgccctgaatgaaatagctgtcagtggagctctaagatctcctttagagggcacagtgaggtgggctgttgggatggccgtaggcaggggagaggaagaaggccactgatgagactgctgacctcctcagaaggttgacctcttctagagagactgcctcccagtgtttaagtggctcattgctccttctgactctgtaaaatggctctggaggacagctcacaggaattctgattgctgaggtgggtgattgagagctgttcaccatgtgtgcagcctgtgctccccttctatggatatgtgtgcaatttttgtatgtatttttttagctgtatattacagtgtttatgttgcaacttcacctgaagcgagtctacagaaaccctcccccttcttcccttggcac

SEQ ID NO: 9753 - DNA, 1114 bp, Homo sapiens
aactatattatttgttttctgatgagtctttgaaaacttagaatattactattatccttgattttaacctacaaatattttgcccctgaaaaaatagctaaaagtgtgaactgttatattactacagattcttacagtctagccatgcaaacataactaacaatagatggttccccacacccccaaaactgtcaaaggaaacaattacaaagactgtgattaatactggtttggcctcattatacaaatatgtacagacagcgaggctgatgtccccagcactcatgatgcaattaattactctgacaagagtttggcaaagttttcatccactgtcaggagccagtgagtgaagggaagctaatggtctacaagtttcagaggagcatattagggacctttagaaatctaacattttatatatgaagaaactgaatcccagagaggagaaacatcttgcttgaaaatatctgcgtagatgagtacagaatccaagactagaaccacagatatctaaactctctcattcactgggtttctaaaacattgctctaaggaagaggtggatgggggaaggggaaagcactaaaaaatcctgaaatagagcattaagatacataggaagtaaacagataaaaattgtaatccaggaattataatgttatagaattttagctcattttaaaattattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcacataatacatctctatacatgcagatatccttagttaacacttgaagaaaattggttttgattgaccatacattcttcagactaaagtagggtactcattttccctcctcaggtttgtccctgatagttgcttttctgtgtttagctgatgattttcctacctccc

SEQ ID NO: 9754 - DNA, 1385 bp, Homo sapiens
ttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggt

SEQ ID NO: 9755 - DNA, 1219 bp, Homo sapiens
ctgactagacctggcttggggtacccgggcctgaggagctgcccaggctctgctacccctgtgtcctaggctggcaccactatgttctgtcctgtcctccaggatcaacaaccagtgggagatgcacccagggccagctggcaacaggggcctagtttggggctggtgaaccgtggggctgagcaggtctctcttcactggtctgggctgctttgtggctctgttgtcaggattggaaagccaaagtgggccctggagcctgctcagcacccacttctctgcctccttggagaagtctgcagcccataatatatgaagaccctggccccaaagcatctcctacatcttcacctaccacgcggctagaaattccaacatttgcatcttagatttgatagaatgttgattctgggagggaccctgagggcttttccatcttctgcccacattatagctgtcaccttggagccccatccacccatccttccatctatcccatctggaaggccttgtgaatgcccctggggtcctaggcctgtgctggacggcacccaacagggaatcgagcagaaaggaggggctggtctggccctccagggaaggcggaagctgcttgccctctcaagggctgctgggagccaggtgctggttcgatgccagcttcctgagcttccctttcaccatcacggttgaagccacccctgggcaccacctgcacttgtgttttcttaatccttgtcttcgtgtggactttcgtttgaaggtggattaccacaatgctccccaagcacacatccggaaatcacacctgtgatgtgcctgtcatgtttttttttccaatacacagaaagagaaacacgtagctatgaaaatgaaaacatttgtctgcacaccacgaaatccccttgtgcacccccagaagcatgtgtctcctactttgggaaacacagatctgattgaaacctttctgcagcagctcagaaagatatttgggacttggtctgagaggttgaagaaactgaggtacagaggaagaagctttccccagggccacctggccagaaggagggagagctaggagttaacccacttccttggactttgaactgaggttatgtcctgcaccatggacgcctcagagccttgccaaggaaccagaacttcctagcgccctcccctactcacagaggatggagggtctggtctagaggaacccttg

SEQ ID NO: 9756 - DNA, 1640 bp, Homo sapiens
aaattttggtaaagctccctgcctccctttgcatcaagagcaccttattctttgcagagtgctgttgtatacactatgagattggatcccgatcctcctgggctgggtagatggtggtggagtggttcctcactttgaaatgaggaactaaatgaaagagcagccgagtaacttgcccaggtggcatctcactgagggctttaaaatctccttggtttagtttagtttgcggatacatcttttatttttgctttttccttttctcagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcc

SEQ ID NO: 9757 - DNA, 1148 bp, Homo sapiens
ggtccacaatatcatgttgtctagctcctggggacaggcaggctccataggccactaataacagagtgagaattactgactgtggggggcggacacaaggggtcagctgaggagcgcagtttgtgactttccctataggcagtgacctcggggtagttgtggggctctttcttcctggaagcataaatgttggtctcttatggcttccgtcttcctggcattaggttacacttcaggattctgactctttgaaagggttgtagatagtcttgattagtactgtatttaaaaatgatttttttttttttttttggagtatgggaaggggcaggaattctaattaaatagcaataatggaaggtgctcggttaaagcctccattctcactgatttagaaagtacaagaacatcctcatctcagttttggtagattcagaataacgagaaaataaggatgttcatttcataaatattataaagaataaaggcatttgtagaactatctttttttaaatttacaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaacactggtgtccttgaacatgcttcttttttcagttaccctattaccagtgaaacagtgagagggattggcattaagagcaaatctctgccttagccatcaagagatccaggtatttctttaactttccagcttagaaatacaggctgactcttccagggagttgacttatgcagtgagatacagcagcgagctccccggagctgtgataaagaagctaatctattttagaatggagtcctgaaggaaagagtatatttgactgcataggaacattatgtactcctgtctatctgggcatccttccacttgatgtattaaagatgtcccctgccaagccct

SEQ ID NO: 9758 - DNA, 2220 bp, Homo sapiens
atgaattttactcactcaggcattccaatttacttttaaactttaatcatttttgatggaaaattttaaatttattacagacatttatacagtttaatcattttctttttgccataccaggggatgtctgcattattgaattgaattctgatattctgtgcttttttttagtttttctgtgaattccttgaatatgaagtatttgtcatagttgcagtatgatattcctaaattaatgcagctcttgtatgaaggtttttatctctgcttttttcaaggctttgaggttatgtacaggaaagtcagttacaaaacacctgatgttaacacgaatggtgttacactctagtttgtcagactaaaaatgaattgtttaaattgagaaaacagtgcatttttgtctttgtctaactttttgctatggcattttaaaaataatatataggtatgactgtttgcttattaatagtaatattttcttgaatcagatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttacgtgagtaatgggtttattttttgtgaatgaactcttagagtgtgtttcctttttaaaatacagactcttgggtaggtgtggttgttcatacctctaatcccagtactttgggaggccaaggcaggaagatcacttgagcctgggagtttgcagtcagtctgggcaacatagtgagacgctgtctgtacaaaaaaatttttttaattagccgaatgtaatggtgcatgcctgtagtcccagctactctggaggctgaggtgggaggattacttaagcccaggaggttgaggctgcagtgagctgtgatcacaccactgcactccagcctgggtgacaatgcaagaccctgtctctaaaaataaaaaataaaataaaaaatcagacttcctaatggatggctctgtgtttttttgttttgttttgtttttgtttgtttttttaaggttagtttataaacttaaaaattttgccctttctaaactgaagcaattcattaaaaattaggcactgttttgtaccatttattcaaaaactgcttttgtttaactaccttcttatgatctctcaataggtttctcaaacttaacatattgaaaacttgattttattttgaggtagtctcactctgtcacctaggcgagagtgcagtaatgcagtcatagttcactgcagcctcaacctcctgggctcaagcgatcctcctgcctctgcctcccaaagctctgggattataggcatgagccaccgtacccagccatcaaaacttgagtttttgattgtctatctcaactcacctatttctttctaagtcttttctgttatagtaaatggcaccatacactcccatttgtttaggcttcaaatctaggagttagccttgatttttctctttctttaataccctctaacccagtctatcagcaagctctgtcagtgctaccttttaaatatatcttgtgtccaattatttctttccatctctatcactgtcattgtggttctagtcccattctctcttaacctggactataactgcaatagtctcttaactggtatccttgctgtcacacttgcaatcaatagtctgttctttacacagtagatggagtgacttggttacaaatgttaagtcgtattatccctccatataccagttggcttccatcacacttaaaatccagagcctttaccatactctgaaagattttgcctgatctaggtgtccaaggattatttattggaagagttaaccttgagctgagttttgaaagaggcgtagaggttagctggaacatcctcttcacccacccactcaaatctggtttgtgtgccacagctctttgtaccctatgtatgctgctattatggtacttacgatacatagccgcataagaaataaatgatatttcttacaccatttattcagaaactgcttttcttaactacctgcttatgatttccacataaccaataggtttctcaaacttaacatgttgaaaacttgatcttattttgagatacagtcacactctgtcacctaggctggagtgtagtgatgtgatcata

SEQ ID NO: 9759 - DNA, 1197 bp, Homo sapiens
taagtttcttgtatttataaggcccctttgaccaagaccaaactagagaagacatatttctgttgccataaagtaactttttaaaaacgttccctggagtagtagaataagactgcaatttattatagcccatgagagaggttttgccctcgagataaactgtagctctaaatttcttttaagttgttagggggaaaaaatctatttcagtacttgctaaaagttatttaaattagtagagtatttgaaagtgattttactggacgcttagaattctgttttcatttctgtaaatttaaatgacctgtttctttttttatatatatataatctgagatttgcctttgaaacctgagttaaatgatacattagcctttaaacatcattcagttacttccagatagcgttgctaatgtgcgtttttttttaagagctaaatttgtgtcccttttaaatggctttattttgttttctttttggaatgacagtgcaatacagaatgcaccaaatcctggaggtggtgacctgcagaaagcaggaaagctctctccagttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgagtatgagattgtttttcttaaagtttattaataccaggttattttccagttaagaaaatcaaatttattctcttcccacccaattactattatgttaccttcacacttaagtactgaattgaatttttatatgtatttcctgttatactaaaagaagtaaatttagtgaaaatggtgatctctaagtaccattctctcttaccattactaagaaagcaaacttttcttaagatttatctgtaaatagaattcatctttttgacgactgtaagcagaaaaatgggatctcattttaaactaaaatttttattttagtatatttgtaccattcatatactcgttagtcattcatatttcttatgttaattccctgtatatatttttaacatttttttcctactagggggtttcttatcttttcctattgcattaagagctctatgttggctgggcgtagtggctcatgactgtaatcctagcactttgggag

SEQ ID NO: 9760 - DNA, 3502 bp, Homo sapiens
agtgtgttgtggaagagacctgtaagtatggggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatggaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaagtctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgttggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaaggaagtgtaatgtcagacacacaagaaaagcaaatcagtgttgtaagcttaaagtacaatttcaaaggtcactaccaacagcagggttttttttatactttgaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcacatttgattcttgttctgttttgtagtagttgaaaataaaacaacatgatgtaaaaaatatgctgccatccggctgggcacggtggctcacgcctgtaatcccagcactttgggaggccgaggcaggcggatcacgaggtcaggagatcgagaccatcctggccaacacagtgaaaccctgtctgtactaaaaatacaaaaaaattagccggacatgatggcgggcgcctgtagtcccagctacttgggaggctgaggcaggaggatagcataaacccgggaggcagagtttgcagtgagcagagttcacgccactgcactccagcctgggcgaaacagtgagactctgtctcaaaaaaaaaaaaaaaaagcaaaaatgaaatgtcccgccatccagatgccatccaggagcagc

SEQ ID NO: 9761 - DNA, 1218 bp, Homo sapiens
ctcggtctctcaccagccagagtgatcatttaaaatgccaatcagttcctgtgggccttgggaatcattcagaggagccccattggctgagagataaaattctgtttttacctgggcacgcgggctctccaggatttgattccagcttacctttccagtcttgattccctatattccagtatttggaaatgtgggccttggactgaggctttaccaaataacgctgaacacctagtattgccttttgcacgaatggtactgatggtgcccaagataactgcctccacccccaagttcaggacccagatcactctctggagaaggcctcagcctcttgccttggctttcaaggctctgcgtgatttggatactcgcttagctcttatttatatatattttaaaagcatcagcagtttatctcatgcccactaaactatcctgcctccgtaccctttgttcatactttctgctctgtgtggaatgcccttctttcttcccctgttctttctcttagacccaagggttctcagccttatttctgcctctcccatctctgatttactttcattttctgtatcgatttctcaaaaaatactttcttgattctttcatcatcccttttcccaccctacccccggttcctctttccacattataatctatgactgcctctctcacctaactgccagtattagcttttcaggacaggaactggttttacacattttggtattccagcatctagcataatgcctgacacttagctgaataaagggagtaaataaaacagatttgtaaagtcagcaaatgctttttaatttgtgaatcttattttaatgatgatctgattttctttttacaggaactatataaagttcagaaaacatggtgagttaatacacatgccaataaacggttgcctgataaacagtattgcttgtactcagtttacagacttgagtgggaaaattgaaatagaaggaaagcagtgagaaggtgccttttttcttgtcagtttcctctcacctattgaactttgtataccaggataggttttgtaagatcatttgtaggcttgcaggagttggcctactttcagtgggtaggaatcactcatgtgtttttcctttgcagtctcgaagatatgactccaggaccactatattttctccagaaggtaaaatagaaattgtttaatctgcctcaagtttaaaaata

SEQ ID NO: 9762 - DNA, 4090 bp, Homo sapiens
atgttatggttaactatattaatcctacagtagtatagaacactagaatttcatacattcttgcttcatgaatgaacgtgttcctccaccatgtagattaccctcgttttattaataggatattgaaagtccaaaacaacattttcaaatctggaaactaactgctgtttacataataatgaaattcagcactggtcctttgtctgttccctcttctggctgtgtccaaatcgtagaaacaaaagtcgaatttgtaatggagcttatctatggtagccagaatacaaaacagtttatgaatgcttaagttcacagagtagggtttagctaccttcactgagctcaagtaactgtagtgatactaaatttagattattgatatgtttggctttttttctttgttaaaggaaaacgtccctttggtgtttcattgctgtacattggctgggataagcactatggctttcagctctatcagagtgaccctagtggaaattacgggggatggaaggccacatgcattggaaataatagcgctgtgagtatttttgttgtgctataaaatctagcagaatgtctaataactgccataattttgccatggtgatgaatgtaaacagtattttaagatagctgcaacaaccttaatgtgatatggaaatatctgtgatttctgttggtgacagcattgctgatatagctaatatactggggttcgttaactacattaataaatgctaattttcagttaggagttgtgaaattagaagctgtgattttgtttcacatctagtttacagaccccctgtattctatgacagaccccttgggagactgaggaccccaggttaaagacactctttatagagcattagtaccccctcttctcaccccgtgccgtgtgtgccctccctgtcatcaaaattatgtatatgggccaggcatggtggctcatgcctgtaatcccaacactttgggaggccgaggcaggcaaattgctcgagctcaggagttcgagaccagcctgggcaacatagcagaaccccatctctacaaaaaatacaaaaatttgctgggcgccatggcatgtgcctgtaatcctagctacccaggaggccaaggtgggaggaggagcacctgagcctggggagacttgaagatacagtgagctgagatcatgccactacactccagcctgggcaacagagtgagcccctgtgtcaaaaaaaaaaaaaaaattgtttatacttgtaatgccaataataattcaggcatttttcttctagaccaattcatgtttctaaaaaatgtaaaaacttaaaattctatgttgattcatgttttataggcagctgtgtcaatgttgaaacaagactataaagaaggagaaatgaccttgaagtcagcacttgctttagctatcaaagtactaaataagaccatggatgttagtaaactctctgctgaaaaaggtaattcatatcctctcctttaattctttcgactgagtgagggaaattagcagctgttaagatttttttcttttttttttttttttgagatggagtctcgctctgttgccaggctggagtgcagtggcgcaatctcagctcactgcaacctccgcctccttggttcaagtgattctcctgcctcagcctgccgagtagctgggactacaggctcgcgccaccatgcccagctaatttttgtatttttagtagagacggggtttcaccatgttggccaggctagtcatgacctcctgacctcaggtgatcctcccgcttcagcctctcaaagtgctgggattacaggcgtgagccattgcgcccagccagcaactgttaagattttaacatgtcatcctagttcattgaaacagcaaccttacgaattaggtgatgttatccctgtcttctaactgaggacactagggcttaatgaggttaagtgagttgaccaagatcaacattggtaaattgtggagtcacaatctcacactgtattccaaacttaaaggcttgatactgaacaatctcattactcacagatagacatcctgcactgtgctacttttagttaacagttatcaagtcttctcatcaatgatatctttgcttgtgtgtatatatgataaagcatacgtatgtagttatatatttatacataggtttggtatactttaccagagatacaacatttgcgtgggttgtgataccctctcctgttcttcttaatctactaatctcttattttaagctcatgttagcaattccaaataccttgttcaacttaagctatatgactatataaaagaatatttcagtcgagcttggtggctcatgcctgtaatcccagcactttgggaggctgaggtgggtggatcacctgaggccaggagttccagatcagcctggccaacatggtgaagccccatctctacttaaaatacaaaaattagctaggcatggtggtgcatgcctataaatcccagctacttgggaggctgaggcaggagaatcacttgaacctgggaagcggaggctgcagtgagttgagatcatgccactgcactccagcgtgggtgacagagagagactctgtctcaaaaaaaaaaagaatatttctaaatgtttttcagaaattgtggtaaattaacatgttgctttatgttaggacagtttagctcctggtgttccttagaaaatgccatttacggccgggcatattggctcacgcctgtaatccccagcactttgggaggccgaggtgggtggatcacctgaggtcaggagttcaagaccaggttggccaacatggtgaaacccctgcctctactaaaaatacaaaaaattagccgggcgtggtggtgcgcacctgtaatcctgctactcaggaggctgaaacaggagaatcacctgaacccaggaggtggaggttgcagtgagccgagtttgcgccattgcactccagcctgggcaacaagagcaaaactccatctcaaaaaaaaaaagaaaaagaaaatgtcatttacatgcagattgccctcttttgtctacttccacccagtttcaaggaagcactactcagtttccctggtacaaaaaaattccttcccctttaggtatcagtctgcttttcttggccatttcatgccttttatttatttatttttttaagagacttgaaaagtccataaaaaataagctgttattaccagttgaagattctggctgagccctcagaggttccaacagttccgtctaatcagcacagctaatagcaggccggcaatagcaattggttgattatactttttctaagggagtgacaaaatggctgaggagacgatatttaagtaaaaattataattaaaacattacaagatcaaaagtatattgttctcataaaagggaataatgttaagtataaaacataggagagtgctgaactaacgtttcaatgatgtggcgagcataaaccatgagtgcctattaagcttctctgctaagtatgcctgcctgcctgcaatacaaataaatgtatgtgtttgtttttagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaataaattctctgtagcagtaattgttaaatatacaaaaactgacagggcgattactttttgcacattgtggcttacagtcctttcacaaagatgggcacgttcctcaggctggccag

SEQ ID NO: 9763 - DNA, 1416 bp, Homo sapiens
ttagcagtgtgactgcttttctcttcctgcccagatggagtccgcctgcgtgaccatccatgaggctctgaaaacggtgattgactcccagacgcattaccggctgcgggaggcccaggaccgggcccgagcagaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcctggagacttgtgcctttatttctttgccctaaaggactccagagcttactgcagagcatgggtgtgtgcataaataattagaatgtgacatagagtacctagagaggtgcatggggtgctgtgcagagatgtatagagtgggcaagaaatgactcctcccaggtgactgaaaacaaaataggaagtctcctcgcatgctcacaccatgttgtacaacggaactttgcaaatgctgtttcctctgataataccttctcccggatatctgcatgccctgctccatcatttccttctgacccaaaggcacattatcagtgaagtccctcccaaccactcttcaagatggtactgtctcacttgcccttagtcctccttgcccattagtaagaaatgaatgcataccaatcagatgtctgtgcagtaggtctggagggaagatacagtgtctccgctgaaggaaacctatcaaatctgaaatcctgcaccgtctgacaggcgttaatgcattgtaggaaagg

SEQ ID NO: 9764 - DNA, 1115 bp, Homo sapiens
ttattttttgtagaggtggggtctcactatgttgctcaggcttgtctcaaactccgaggctcaagtgatccttccacctcagcctcccaaagtgctgagattatagacgtgagccacagtgcctggcctggtttttcatgacatgaatacaaaccctgatagtttcagttttacaagcctcatgtggctgtcaagtcttgaaaggcaaaggctgtatgggatgaagaggaaagagcagagtggcctgggatgcactgaagggaggggaggctgctttggagctcaggggagtggaaggaaggccgatggcgggggcagggcacaccactgcactctgctttcctgaggcgtccatctgacctctgacttagaaacacagtggattcatgccaggcccctgtggcagtcctggtccatggctggagtttggaaatacctgacctttgctctctaggtgacaagtgacctgggcggcagatcagctccagattctaatgaactctcccccatgtaaggctttttttgtaggccctggaaacagattgggagagccgatccccatttccaaggcccatgagcacatttttggaatggtccttatgaacgactggagtggtaattactggagctctgctcctgtagagatgacggggaggaggctggggacttggggcaatttcatagaagctgaagatctggtgcaggtcaaaagtggcaggtgatgcagtgactgagagtgggggtctgggtatcaaacagactttcagctctaagaactcgggccactcacttaactcctctgagctccaattttctcgagtggctagggacacggctgacatcataactaatatttactgagcacttatgtgtcaggccctgtgcttaacacccttcgtatattctcccgctgatccctacacggtatgtgcaatattatcttcccattttacagatgaggaactgaggcacagggagatttcagttagttgctgaactaagatttgaagcaaaacagtccagcttctgagcctgagctctcaaccctttgccatacgtgggaggaagatggcaccataagccccagaaagtgtctctctcatagtttgagaatg

SEQ ID NO: 9765 - DNA, 1165 bp, Homo sapiens
tggctgatcctgatggccagggagactctgagctaagatgtgaggtccacctacctcaccacccaaggcacttggattcagaaagagaagattccctcttggaggaaatcaggtgctgtctgtcactaaaagaaagaagagacaagtgggcaggcaggcactggctggctcaggagagctggcctcggtggtattggaggagctccttatggggaaggacgagtgttctgcagaatgaaagtgccttttcctctcaccaggaatgctgggatgtttgggttacaggattctgagaagaagatggagcatggaggtgccaggatcagatgggagtggtgtcagggaggggccacagaattaatgatcctggatatctgagtggcctaagccccagctctctgcagggaaggagaggagctgaggagaggcccagggcattccaggtgatagcagagcctgtgactgtaactggatatgcccaagaggtggggttcagagagcaagcagggagcagcagaagcagctcagcaggggccgcccaagggagcatggagtgagcagattctttgtgccttccggtggcctttcccaggttccctcctgtggctgttgaactctggagaaccttgatcctggtgagcagaactggaggcgccttgtgggtgacctcaagcactgccctgggtggggaccgcctggctgtcctggctggaaagtggatgtgcacaagcataacccacggactcttcaagacaaggtcgatttggcctgtttcccctgcatcatacttccatggctctgtttctgctggactcttcctgcattcagagaattgggtcagcattttggttcagtgtagaaaatagcttcaaaatagagctgtccaacagcagaagagggtgcaagcaaaggccaaattcctccctccctcccttcctctccccatccttcctgcctgcctgcctgcctgccttctttgcttcctttcttctctctctctcccctccttcctccttccctctttctttctttctctgaccactacttagtttattcatttattcatccattcaacaaatacctgccttgcatggctgtagaaaggttatgtgggatgcagcttaccttgcgatcagcctctccttcccctatctcctatatgcag

SEQ ID NO: 9766 - DNA, 1301 bp, Homo sapiens
ccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagac

SEQ ID NO: 9767 - DNA, 2438 bp, Homo sapiens
tattatctttacacctttcctgcaaattcaaaattattctaaaatgcaaagttgatttaagaaaaaaaactaaattaccagaaaaaaataaagcaagaaaaagccaaactgttatgatatgttaatgtaggttcatcaaaggtactgctgtggtaggggatattgataattggggagactgtgcatgtgtggggacaaggaggtatctgggaaatctctgtaccttcctctcagttatgctgtgaacctaaaactgctttaaaagataaagtccttaatttaaaaacaaaacaaaacaaacaaaaaaaacccacggtgttatttccctgcctgtggagattattaacttatcattaaatgtgatgtgtattatctgtgagcataactaatggagtcctctttctgcctcccccctttctgttttgcagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaatgtgtgggcttgtgcagtttttttcttcatctctccatcaaagaaaatagtgaataagaaaacaactttttgtcgtaatgtaggaagaaaaccttgaggctttcaaactgcaccatctttctcaaggtatatggttttgttctataaaaggccttggattacttttggaagaagccaagatataaagcatatagcagtaaagtgcagatgatatctaaatagaggatgcagtggattctggctatgaaacaaaattgatgaaggtgacctcattgtgacctggctcagaggaaggacagtgcctcttttgttgggaagcctgaaacaggtgtgttccatagttttcagccctttgaccagctgagcagaaaagagcagctgagggatgctagttttcaactcttggaacgcactctcctaagggtgcattaggaggaagtggtggtcaggaaggtgtgaagacatgagtatgcacatgtgaatgcatgcatatgccagctacttcctgatcttgaatcaggtgggtggggctggcttac

SEQ ID NO: 9768 - DNA, 1227 bp, Homo sapiens
aataaactgataagtgccagagaattgctctgaccccttagcaccttactagtacgtgctggctgactgattgcatctctctgcccaaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtc

SEQ ID NO: 9769 - DNA, 1169 bp, Homo sapiens
gagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtcttccggaatttctcaactaaatttcattattgggcaggaaggaggtcatgggttcatttcatttttgttttttgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctcagatggctttttgcaattattgttgatttttcaataattgtaattttgcatgctgcatgtcatgtatgggaagggtctgtgggaaggctatttcaatagtagtgaggcgggcccccaattcccagccctttctactatttcctcaagaaaaagtactgctcaagaagtactcccttgagcagcctggaactgaagagaggactatgtgtaacgttctattttaaaaggcaggtgacacaaatgggattgggttatgtagagtgcttgggacggttttgtctcatttttcctggaaagtgatttagctccctttgtctccacttacctttccatcatcatgaacagtggctcaggctgcttgaattctgatttgtattctgcctatcattttcagattaaatcctaatc

SEQ ID NO: 9770 - DNA, 1158 bp, Homo sapiens
gtggatcgcgctcgagaggagattgaggcgcacattgctctgcgtaccggcggcatcattgagctcacagacgagaacgacttccacgccaacggcaccgatgtgggcttcgatctgcatcatgggtccggcgggtccggcccaggcagcctctggagcaagcccacccccagcatcacgcccacccccggccgcaagcctttctctagctaccgcaacgacagctccagctcgcttggcagtgcttccacagactcttatttcggcggcgggaccagcagcagcgcagcggctacccagcgcctggcggactacagcccccctagccccgccctgagctttgcgcacaacggaaacaataacaataacggcaatgggtacacctacacagcggggggagaagcctcagtgccatcccccgacggctgccccgagctgcagcccacttttgacccggctcccgctcccccacctggggcaccacttatctgggcccagttcgagcggtccccgggaggcggacctgcagctccggtatcttcttcctgctcttcttctgcatcttcgtctgcttcttcctcctccgtggtcttccccgggggtggcgccagtgcgccctccaacgccaacctggggctattggtgcaccgccggctgcaccctggcaccagctgcccgcgcctgtctccacccttgcacatggccccgggggcgggagagcaccacctggctcgccgggtgcgcagcgacccgggtggaggaggcctggcctacgccgcttatgccaacgggctgggggcacagctgcctggcttgcagccgtcggacacgtcgggctcctcctcttcgtccagctcctcctccagctcttcatcctcttcctccgggcttcggcgtaaaggcagccgcgactgctccgtgtgcttcgagagcgaagtgattgccgcgctggtgccctgtggccacaacctcttctgcatggagtgcgccaatcgcatctgtgagaagagcgagcccgagtgcccggtctgccacaccgcggtcactcaggccatccgcatcttttcttaaaggcagcgggcgctgctagtgcgcaccgtgctgggggaagggggaacccctccccaccctctttccccagcgctcgcctgcctccct

SEQ ID NO: 9771 - DNA, 1167 bp, Homo sapiens
catctcggctcactgcaacctccgtctcccgggttcaagcgattgtcatgcctcagccttcccagtagctgggattagaggcacgtgctaccacactcggctaatttttgtatttttagtagacaacagggtttcacaatgttgaccaggctggtctcgaacacctgacctcaagcgatccgcccgcctcggcctcccaaattgctgggattacaggcgtgagccacctcgcccggctggatgtcaacttctaatgcttacttcacagttgcagttactgttcgagagatttataggcatatggcctggaagaatagtgccaaagtcaacgtattaattgccaagttatgtgaatttgaaattggaagaaaatgaaggctgtgaagggtcgtgaaactgcggggcggggcggggcgagttgggggtggggcgcttgatcatcatgaaggagagtttgaatagagagtgagaaaccaaggggaaggaatgctcaggccagtggaggttctatgtgtaggaggtcccaggatagtgagtcctcttccttctcactgtggaaaagaactaaagcgggtatttatatatgcacatgtgctcagtaccaggtgggagttgatttgtcttctcactgttctctttggctgtgtgtgctttgtagttatgtcacgcatctgatgaagcgaattcagagaggcccagtaagaggtatctccatcaagctgcaggaggaggagagagaaaggagagacaattatgttcctgaggtaaactttctggatatttgggcttctggctaatcctcaaatgataaagctatgggttcttggcttccaaagggacctcagctgaatctgagacctttaatccatacattccataaccagctgtgggtgcccataggccccctaccagtttcttagcctccattctgctcttctggaaccagttaagtctattccatatttcatgagagcccttaatgttgatttgatgactgctgtcgtggctcgattgtttgcccctaatatagtattctttggtgtaaacacagacttcaagtgttctgaatactgaatgagggcatgggaaggtaaggccagaagaacaggtcatcggggtctgtaatactgtaagagactgctcaccttgtgagaggaatgctatcct

SEQ ID NO: 9772 - DNA, 1167 bp, Homo sapiens; identical to SEQ ID NO: 9771

SEQ ID NO: 9773 - DNA, 1211 bp, Homo sapiens
cagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagcagagttctggttttgtctctgtgtttgaggtctgggagcaaggggctaacgggagggagtaagggggtaatggcacagccacagcttgtttccttggatttctgtgatggagatcctggcccaggataatggtgggaccatgtgggagacctgccctgtgagtacttcttggtcccttccatcgtcaaatatactttggagatgcttctccagtggatgggtgcttctagcccaaatataaaaagtcctcatatcttagcttctcgggggtcctcacagcctccaggcccagcttagagaatgctggaggcacagctgctcacgtgccagcagaagccacttgttctcagcttctcctggaagtcttggcctattacttcttcggaggctgctcatcctcttggacccacctatgatgatgcagttcctttctgagagggagtgattgggtttttgctgttcagagagccctatcaacggaactttctcagagct

SEQ ID NO: 9774 - DNA, 1118 bp, Homo sapiens
aatagtggccctggagcaacctggacggtgttcccttgagctggtgtgacgtgccctcgtttattctgacatccagcccagtctcagtactgttgtcataaccttacgccagactcaggcagaatgtaagccattcactcgtgagcatcgcagccgcttgtgctgcctggaagctgcagggccaggactgcattttcagtttgcaattgaggtctcctgattttggtgtttccaagactggctgctataccttgataagctttccttctgcctccatgaaacctggtgtctaaaaaagatcaactaaaacttggaaccctttaaccaagaggacctttaaaaataacctttcattccagtcaagacccagctggatgcattttaaagttgggagtggcgaggaagccttcctagtgccgcccggggaatgtaaaaccaccagagcaacaggttgggacagtatggtcaggccttggagggaaagagaaccagtatccacacaagacctcgaacttgtgtggcccctcagtttcatctctcctgcctgccatcacattagactttaattgggtgagagaacagggcagagactgtcacctgcattttgcagatgggaagtagagacagagaaagtgacacgcccagggtcacccagcggtgaccagcagcgtggactctgcatccaggtctcctggaccttgatgcagtatcttttgagacatgccactctagtccctttggtgacccgtgggtgccaagagaaaataattcttatatcctgataagagcatattacaattatattatttcaatatgtgtccacagcaaaggacagtttacaaaaatgtgaatccgaatgacatttaggaatgtttgttataaatgataagttccactttggaatgattctggttttgcaggaatctttccaagaaagttggttaaaatgatgtctctgcctgtgaggccagttctatggaaaacaaacacaccctgagttctttattgatggctttagtggaggcagagcagtatgttcaaaacaagtgggaggccctgagatcgcaggaatggaaacagagttctggctgggggtggcctgtccactgcccgcccct

SEQ ID NO: 9775 - DNA, 1419 bp, Homo sapiens
gttttattgttgtaggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagtttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatcactttaatgattattacaatgatttcattcaaataaaaattttaaaatatttaagcatcttcactcccaagttctggcagttagcccatttattaatatggtgaaatgagatttttgggtttttttatgctgtccttcatatctgttgaaaagggcttatttggtttaacagtaacattaagagtgcaaatttcaacataggtcaaaggaattaacaggcaccttcctgactttattagagtgacaaaaaaatatatatatttaaaaaggcgtcttccagccaggcatggtggctca

SEQ ID NO: 9776 - DNA, 1267 bp, Homo sapiens
ccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgatatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaactcttttatgtcatttgcctttttcttctaaaagtgaatataaacagaattttgatttgttttttgtttgttttttgagatgaagcctcgctctgttgccaaggctggagggcagtggtgcaatctcggctcactgcatcctccacctcctggattcaagctattatgcggcctcagcctccagagtagctgggattacaggtgcccaccaccacgcccagctaatttttgtatttttagtagagatggggtttcactatgttggccaggctggtctcgaactcctgacctcagctgccttggcctcccagagtgctgggattgattacaggcgtgagccaccacgcctggctgtcaacaccattttggaacaaaggttctagttaattgaggtttaacttaatgggagtaatgcaatacaaaatacaaatacctcattgctgatttaaaccagttca

SEQ ID NO: 9777 - DNA, 1240 bp, Homo sapiens
aaaaaaaaaattattagcctgggcgcagtggctcacgcctgtaatcccagcactttgggaggctgaggcaggcagatcacctgaggtcaggagttcgagaacagcctggtcaatatgacaaaaccctgtctttactaaaaatacaaaaaaattagccaggaatggtggtacacacctgtaatcccagctactggggaggctgaggcacgagaattgcttgaatatgataggtggaggttgctgctgcactccagcctgggtgacaaagtgagactgtctcaaaaaaaaaaaaaaaagaaaattatttaaagaaatgtgatattttgcttagtattggaaacttttaaatggattatagttaaaagatgaaagaataattgggtagtttagcgatatattcacaaagaccaatttgttaattaactcttagaacctctgaacttttcaacgcttctctgacttgtggttctgtgtttattttctagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaccccttatccctgaattgtgtttgtcgggaaagcttctgaaatttgccttccttggctggttcttagtacccctgggggatataaaggcttggtgtgaacagtccttcagctaagaaggttgctctgatactaacaactagtttttttgtttgtctgttttgcgtgtgtgtgtgtgtgtgtgtgtgtgtgtgtgtgtgtgaagcaaaagtagccactgacagtcatagg

SEQ ID NO: 9778 - DNA, 1143 bp, Homo sapiens
ttcctgtggtgaaaccacagcaggaaccccatcagttcagaagtcttacttgattccagatattctctggggtacaacccttctcctcaaactcaagtctagaataatattcacagaaaagatacatcgaatgtggaatccctccccacaaagtggagggttctagatcctgtttgcttctgcttccacagactctcttagcccctggcagagaggccatggacagacaaacattgcccttgggtgaccatcccttcctctaaggcacagggaaaggcacctttgaatgatgtgtctttctcactacagtttctcctgcttctcttccctttgccccctcacagtcctctctgccgctcacaatgggatgtgtgcctggggagggagggccgggcacggcttgtgcaccacacaacctgccttcaggtggcgcttcacacctaggaacgcactgtgtctctgctggcccttgaaagggtttggcatggtagtttgcttcctgggcccaggaaggagaagactgtaagcctgagcattgttggtgagtttgtactggactcagtgcttactgatgcccctgaaatctgggagatggactggagaagggaactaaaagttctggcttttgcaggggtggatccgtttgtggtttggcactcctgctggttggtcctggagcagccaaccatgtttcacttcagcatgtggtatccagggatggagcaggggagccacagctggctttccaaggctgcttcccagccccatttcggctgggtctctcctttctgatacccttatgaattagagtccccccttgggtctagacccctagcattggccagcttattctttgtccattgtgggtctgcactcacaaatgtaggagctttttttctgagcccaagctctaggagaggctcctgtgctcttaggacccttgaatcactgagggttggctggccttcccctcttggcatgaatgaaggctctgctatgctgggggctccatctctgaggcttgacctacttatctgtgtgtctccctcatgcaccagtgtccctggagatgaaaggtgcagggtgaagtaaggcccctcaaacaatgatgggatgggacacctgggcttgtagactggcatg

SEQ ID NO: 9779 - DNA, 1166 bp, Homo sapiens
cttgaagtttacactttgccactgctggaggctcccctgagtcctctgcatgagttctgcaccccaagcccttgccccagcccagtccagcagcagatgttacaatctgagtgaggacatgcaggccaacttttaccctcctgcatttgcctggccctgatctcgcctgtcctcagggatccagacttcctctgctggtctggcctggtgactctcagggtatcttctccttccagctactttcgctcactgatctcagcttatcctgcaactaaccatccttgagcccagatggggctcagggcccttccagagcctgtcatgtccttgtgcagtggcctttgatgtgtgttcacgctcttcccccttcactcactcgcctgcttcccatgctcccttgtaccccctcgccacatccctgtcttggggcccagctgcagcctgctgcctgcccttcatggctctgcacatggccctttgcttgagggctccccactccctgcccaccaatacccaggtgaggaacagaccctctggcctctcaccccacttcagtgctctcttccccaacttctctcgggctctttgctcatgaggtgagagctggtgtgagggttgtgtcagcagctgtagccagagagaggtgttgactctgagagaccttgcactccatactgaaaggaggtggggtcacagtgaatttcacatcccctctcaaccaggagtggagggctaggtcccttccccatggggagtacacttgggtgttctaggagggatgcagtctatccatgcacttgggtggaggggagtctctgtgcctgggaattaggacccctgctccaaccatcgctcttgatcctggggccccagctctgggtcctcatgtatgggctcccaaggacccagcagcctggatccttccagagcatccctcctggaggcctgggatggggtaggtctgcagctagcctactccctttggaatgcaataaaggcagcattgtgtgccctgcttgccctcatctggtgtggttggaggtctgtggagtcaaggtccccctctcccaggcaggctctctgagggcattctgtagtcccaggcccactggaaaaatgaatctatattttggttcctggaccgaagttcagtcgcagccttctgt

SEQ ID NO: 9780 - DNA, 1397 bp, Homo sapiens
cagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggctgctggagatctgtgtgccttgccttccttcagcaggaccgtctaggtgcgcagccacctatggatgcgtcccagccagccccgtcgctctcgtccatcctcagagacaaagaagagggcagggagtttgggcttggttttgaactttcctttcaatgtagcaaagcattcctagttaaccagagccttggaatctactgcctgctggccaggctttaaaatgaaaagtgttttaatgctgccataaaagggaggcgggggggaggaagggaaaataaaggcatctttccaagtactcatctaatttaattgtcaaaagattgataggccatgaattacttctccatctcactaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagttctggttggtgctgtgacttattcctattcctgattcctgtagaagggatactccccatccacccccatagctcttgaggagacgccttatgcaccgagcagctgctggggacgcatttcactctctcggagtgggacccaaacccagagagtgactgatcagccctaaagtcaaacaaacagtttatgccaagagccaaaacttcctatttccagataaatcaatacagtgaa

SEQ ID NO: 9781 - DNA, 1231 bp, Homo sapiens
tgccactcagtggggaaagcaggcctggggtgcctgaatcaccagactgcgctgccggtgaatggtggatctggcgttctcacgcccgagcctcatgggcagctgtgtcattgtcattttgttccagatcaggtcagaacagaacaatgtggccactgattgattttctcttcctctcctccctccacagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgc

SEQ ID NO: 9782 - DNA, 1242 bp, Homo sapiens
agtaccagggccactgttaccgccacttcccggaccgcgagacctgggtggatgctgagcgccggtgtcgggagcagcagtcacacctgagcagcatcgtcacccccgaggagcaggagtttgtcaacagtgagtgcggcggggcctctggagcctgagaggagagtggcggtgtaggcaaagggcctcacctttcagaaggcagcagatttgggcctcgtgagactgcaggacagggacctgggggagggggaacagtgttcccacagtctgagctcccagagagaagacaacggtctttggggccagaagctgtggctgcagccagggcagacccattgccagccagagtcagcccaagactaagctatggctgtcacccgtccatgccagcttggagaggtggcccgaagtgcactccaggcatgcacgtgctgagcctcttgtgaggacctgagaagcacgtgccttgctcctaggagcccacccacctcctttcctcctccatcccctctgcctccgtgagctcaagtttctcagacaccctcagggtgtccagtgtgatgcctgacaccctcaccctttccccagacaatgcccaagactaccagtggatcggcctgaacgacaggaccatcgaaggggacttccgctggtcagatggacaccccatggtgagttctgctgtaggcacagctggtggcccaggggacagggagtgggatagagacccctggagagagatgcattcaaaccccatgcagacagccgcttaccagctgctggaccgggaacccttgagggcagggattatctccttcatctctgcctctggaacccagcccggggctggacagattgagctaatgatggcaagaggcaaggagccaggaaggaaatgaaggaataacagccaccaccatgaggagtatacggaagctttagagaggtttcttgcccacactgaactcgagtctactcaaggagacagacagaaagcaacatagatgccaagtgaatggtacgggcacccagtgattctctttgtcctgaagcaaggctggaaggataagtcttgggaggacttcttggtgggcagaagctggacttaagagctgtgttcctaccatccatccctacccaatgtggtcagccctggttggcccttctggataagaggtgtggaatcagctcatgtacagagcctgtgagtcttgggggttctgagctcctgagaaggac

SEQ ID NO: 9783 - DNA, 3746 bp, Homo sapiens
ctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccgtgggcatgggtccaggtctgtaacctgaagaagttgttttctgacaatcaccaaatcatccgaatgacatcaaaagcagcccttatctcagagactgagatttctgtggtctcaacttcgctttggtataatttctggcactcaccagcctctatcattatgactttccccccagtgtattatttctctaataggtttccttttcacgttcttttagcacagactggcactttaccctctcagtttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacctctcaccgccccccacccctcactgcccccgattaccctagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccct

SEQ ID NO: 9784 - DNA, 1361 bp, Homo sapiens
tttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtggtgtggctatgtgtcctttgtatagtgccagttttccatctgaaaggattcttcctgtgtcttcaccaaagtatgagattaatggaaatacacaaaaccccatttttgcaccacaattgatgttagtccatccttgcaaacaaataccaaaaccttgaccaggccacaagtgtcttcacaaccccatcttctccgggcaagaaagccaagaactaaaataagtgaagtatctcttttctacttttttaattttttagagagaggttcttgctctgtggcccaggctggagtgcagtggcatgatcacagctcactgcagccttgacctcttgggctcaagcagtcctcctgcctcagcctaccgagtagctgggactacagggacttgccactgcacctggctaattgtttagtttttagttttttgctatgttgcccaggctggtctcaaacttgagttcaagtagtcctcctgccttggcctaccaaagtgttggg

SEQ ID NO: 9785 - DNA, 1237 bp, Homo sapiens
tacaagaagagcccaatttccaaataaggtcacattctgaaatactgggggttagagcttcaacatatgaaatttggggttgtggggaggacacaattcaattcataatgcctctattactttggtctaggccactgtcatctctctcttaaacatggtagcagtctactaacaggtatccccatttcactcttaaacccccataactcattctccacacaaggagcaaggatgatttttgaaaaatctatcatcccatttccttcttttctctttagtaacttccgttgcacttagagaaaagctaaacttcctaccatggcctgtaagattcttcataatctggtcctttcccgtttctcttcaaactcatcttctactactcttttctttattattctccagccatgttgatttttttttttttaagcaaggctttggcctcaaatatgccaagttctttgctgcttcttggacattgcacgtgatcatacttccatctggaatatccttctctaacgcctttgaataattagctccttcttgtccgccaggtctctacttaaatgtcacctacttctgagaagcttccccttactaccctagaggaaatttccttcctttcctcacttattgtctatctcagcctcttatttggttcttttacaatttttttctgccatcctttcccctcctgctctgttatgaactctgagtcaaattactatgtctgttttgttcatctttataacatgcctaaggaaaataacatgctcaaaaagtatttgttggatgaatgtatgttcccaacttagtgctaagttataaacataaatgtttatagaatgagtaagaatagattttagtcttgacaatccaggatcatattaagatataccctcctctgtctaaaaattatggtgtttgtaatacttggcgtctctgaatgatctgaacgtgacagaagagtactttttcatattgagtgtttaggtcattggggtaaaagactgttgccagagacttgtacctttttctttctttgcagttgactaatctccttcagaatcaagcagtgaaaggaaaagttgctggagcactcctgagagccatcttcaaaggtaataataattaatgtcacttctgtctgtctcctgcattcattggtagatttgtttagttttcgtacttttcttacggtttgaagccccactggaacattttccatgttttgagg

SEQ ID NO: 9786 - DNA, 1657 bp, Homo sapiens
atttcaaaactggaagtttacatacaagtgccctggatttcagaattttgaacatgcattcttcagatgatcacactccaggctctaatgtacctggccccatccactctctttacccacttggcagctgcactcaggagagtcatgtagcattttgatgtcaatggcttcttctcttgtcattttgtcccataagtatcctcagtatagcaaaagtcctaaaaggaggtgccactgtcttattactctacactttggaggactccttcctcttcttcaacaacataattacctcctgtgagtgggaaagtggggaaagcatgactaacaaaggctttgatgagaagatagagtcttttttttccttctttttatttccactgccttggagcaggtttatcacgttagagcattaattctttccccttctagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatttcttctgtggttgaagtaggggacaggtacaggtagaatatttgaagctctgctgccttcatttctgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctactctcacagtcatgcccctcctgtgaacagatgcatcactcctggagcaatgaccccacacccctt

SEQ ID NO: 9787 - DNA, 1166 bp, Homo sapiens
acaccattcttctttttttttttttttttttggtgagacagactcttgctctgtcgcccaggctggagtgcactggcatgctctccgctcactgcaacctccacctcccaggttcaagcgattctcctgccacagcctcccaagtagctggggttataggcacccaccaccatacctggctaatttttgtatttttagtagagacagggtttcaccttgttggtcaggctggctacaccattcttaaggtggcagtaaataagacttctgaaggtaatagtctagtgggtcagtgtttttttaataccttgttgggaccatgtatcaaacccctcttagtttgttaagagacacttcagaagtctcttaaagctaatagcttgctgaatttccatcttatatgtggtactatgtaaattttgcccggttttggacaacatgagaaaatgtcaagcttgtagttgtctttggttacttactgtggttctgattttacagaaataagtctgagacgaagtcctcgaatcaagcagttgtcatttagcaggacacattctgcctccttctattctgtgtctcagccgaagtctcgaagtgtgcaaagagtccactctttccagcaagataagtcaggtaacatacgggcccctctgccttcacaagtccgtgctgacttggtgagaagtgtttttgggaaaagaagcaagaaatttgacattttctttcttgacattggagaagtagaataggtatgtctagttgaggttcagggtgatggctagatggacagtccatgactttgtaatcagtcatccctaggactcctacaactggtcatccatgctatcattataggtagctcattcattcaagaggaagctacccataatttcccataaggacagaacctacacatcattatcttaggtggaaggtgatatctgtgtttacgttcttcattcttctatccatggttagcttgctaatagatttgtgtttcttattttatctttttttgagacaaggtctcactctgtcacccaggctggagtgcagtggcacgaacacagctcactgtagcctcaacctcccaggctcaggtgatcctcccaccttagcctcccagggaggtgggactacaggcatgcaccaccacgcccagctga

SEQ ID NO: 9788 - DNA, 1187 bp, Homo sapiens
cgcccactgcaacctccacctcttgggttcgagcgattcttccgcctcagccccccaagtagctgggactacaggcgtgcgccaccacgtccagctaattttgtatttttatttatttatttatttatttatttattttttgagacagagtcttacaccgtcccccaggctggagtacagtggcacaatctcggctcactgcaacctctgcctcccgagttcaagcgattctcctgcctcagcctcctgagtagctgggattacgggcacctgctaccatgcccagctaattttttgtatttttattagagacgaggtttcaccatgttggccaggctggtctccaactcctgacctcgtgatctgcccacctcagcctcctaaagtgctgggattacaggcatgagccaccgcgctcagcctcagtggcattttcctaagtgctgtgatagaggtgggaactggagactggggaagcgcagaggggagtgggggctggtgtgcatgataaggcagtgacattgagttgggttttgaaggatgagtaggagtttgacaagagggagaggaaaggcattcctggcagtgggaacagaatgagcaaagtcacagaggtatgaaaaagccccgatgatctggggagacgctggcagctggagccacagtgggcagtagaaagaggacaggccagagggtcaagttcacagaaggtattaaggcccaagccagagttaaggtttcactctgcaggttgggcaccaggtttgaatgggagagtcccacccacactcttaggcagagccctctgctgacgtgtgctggtggggttgggtgacaggggagggtagcatagccgccactgcccgatggggtgtggaggtggccaggcctgggctgtggcaggggactggacgagggaagcccttttgtgtgttcctgaaggtgggggctgcagagcatggctgtctctgtgcccccagcctgggttggcctggtgcctagagcagggacctctcattatagagccaactttgggctacctgctgcaccaacttggaagaccagaggccttgtccagaagagtaaagattccagccagctgggcctatggtctgaatccaaagcaaacaggaagagagtatggtgggccaggcagggcctctttctttgtttagaaaagggattag

SEQ ID NO: 9789 - DNA, 1039 bp, Homo sapiens
ggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttg

SEQ ID NO: 9790 - DNA, 1039 bp, Homo sapiens; identical to SEQ ID NO: 9789

SEQ ID NO: 9791 - DNA, 1159 bp, Homo sapiens
atttggggaaagcaggggtccatttgtgatagtgttggacccaccaagggcatgagtagtgggcaactttggagtcctgtgagagagggtgtggcacccccccccccttagcagcctgggggacgtcagctccaagggtgagggtttcagccctgggttccttgctatggagtcaaacgtttctccagtgtgtgttcagacttctgacctggacccgccttagccttggggagctctctcaactgcgtcctttgttggatggaaactgcattagacacagaaacacagagctgctcttttccccacaggcaggtgcagacctgaaagagccccgctgaagcggctcagaggcaaggggaggacctcatccttaagtcacaggactcaggattagaggacctacagctttcagcctcggctcaccatctcctagccctgatgacccacagcctccccaagccttggtttcacagcctgtaaaatgggttcatgagcctacttttcatagctacactgtgtgtttgtatataacccatggctatcactattacctgcggaccgcggtgctatgaagtcaggagacaggcctgcaccatcctgaatcctctgttctctgaaaaatcgccctttgttctctcttacttccttcattcaatcagcaaacatttaccaactacctaccatgtgttaaactctgtcatattaaggtgaatggcatggtctctctccccagtgagcccccagtccagaaggggtactagatattggatatagacacaaaagcacaggaagttagctcttcgaatgtgctgggggcagggggctgtagggaagactgcttggtggaggtggtgtctagctgagtcctagcagacaaaggcggcatgggggaccaggcgtggtggctcacacctgtaatcccagcactttgggaggctgaggcaggcggatcacctgaggtcagaagttcaagaccaggtgaacatagcaaaacccgtctctactaaaaatacaaaaattagccgggcatggtggcgcatgcctgtaagtcccagctacttgggaggctgaggcaggagaatcgcttgaaccagggaggcagaggttgcagtgagctgagatccagccactgtacttcaggctgggttacagagcgaga

SEQ ID NO: 9792 - DNA, 1203 bp, Homo sapiens
ctggataaccctcaccaaataaggggcccgccaccttgggtttggcagcctgtgttgacacatcctttgtgacagggacacatgtgtcccacgcatcagagggatttcaaaatgtcacctgggagctatagagaattttcactcaggttttcctaaattatccaaacagaacagtttggttttttccctgtaggcctctttatttttctttaaacctgtggaaacgaacctcctctgagagccgacatatgcttgtcaatcaggcatgtgcgtgtgcctggttagcacatttactttacctgttaaagcagtggctcctctcctgtgtgcatgggtcagtggatagcaccgcagcaaggccagcactttctacatccccaggggccaccagtcactgtggtctgaggagtaaaggtggccctgcctactcttgaggtgtgtttatacctgtgtaggccaaacccccgcactgtgtcacacctccacattacaatcactgctccctcccccagagtgcctttcttctgttagtctgcctgctgaactcctacacaacctacaaaaccttgctcaggtgtcacctccccctttgactcccccacataagacttaatcacatctccctttatccatctcctgggagttgtatgtcatagctgtcaactcactaaggtaatcatccatttactgtggctgctggagggcggagactgttgtcttcatctctctagctcctaggagaatggtgtgctgtccatgtttgccaggcagaaaagccttgcaaaacctcagtcactctacagtgacctcagagcttgagcctggtcaactggaacagcagaaagaaggaagctggaaatggcggatggcttcaaggacgtgagccatggagaggttagacagtgacggctgacaggtttgccgtctgggaactgttgcggacctgggtaagggtgcagctctagtgaggtcaacactgaggtgagcgcagaagccatgagagatggtttctctgagggagtccactcaggccaaggcctgagcccaggggccgctgggatgcaggaggccagggagtggtggtggtgcgtggcctgtgagctcagagagggttgtgtggctgctgccagatgaggaggaggcccagctcaaagctcctgtgtttggcaaagggctgccaccttccagaggacagctgagctc

SEQ ID NO: 9793 - DNA, 1570 bp, Homo sapiens
cctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccggcggaggaggaggtgctggaggtggaggcagcctgtgagaagcacacccggcggaagacgcggccacctgtgcggttggtgcccaaggtcaagttcgagaaggtggaggaggaggaacaggaggtctatgaggtttctgtgccaggtgacgacaaggacgcagggccagcagaagcccccgccgaggcggccagtggcggctgcgacgccctggtgcagagcagcgccgtcaagatgatcgacctcagcgccttcagccgcaagccccggacgctccggcatctgccccgaaccccgaggccggagctgaacgtggccccatatgaccctcacttcccggccccggcccgggatggcttccccgagcccagcatggcgctgcctgggccagaggccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaaggtaaggccgttcccagggcctgggcatctgcctgcccctcctgccactttttcatccagtactttccaaagtcccagatgggaccatttaggt

SEQ ID NO: 9794 - DNA, 2029 bp, Homo sapiens
agacccctgtcctacatccctttctggaagtgagtgtccctacagtggattgcaacacatgtcgtccacttcgaccctagctggagtgcctcaccagggggccccactaggaacaaagccaggacaggccccgcgtcaggcacacactaacaaaaccagaagcatggggcagggcagggcggagtgagggcatcacaggggaccaagaagggctgtccttgggggaggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaatcaagggtttttttgagcaaagggggtcttctgaaggtaacttattatttttttctttccaactgtgtgtcacctatgaccttttctgatggagatgcattttctttttccaagcgtaagcttcctaatgtgctgtgcgtgcttcctacccacccaccccgagcagcctggccgggcaggactggggctccatggggactgtcaccctggccctggaggtgcagccgctggcagcagcctcagcaggctggggtgggaggcaggagaaggcagagctgggaagccctccacccctgcctggctcctgcagtcgctgacttgctctgtcccatgtcccatcctcggctgtcagggctgctgactctgctcagccaacagctagctccctcgctcgcctgctctcttcccctctgttcccacgccagctcctgcccctggaaccagagatgacaggcccagggcagtgaaatagcacattcaggaactctagggcacccggacccccccacccacttgcctcctgaggcctcagtggggaggggcaagcaggggtcttccccaaaggcacagatgaagccactagcttcagcctagaaacccggagaagggaacagcctgcggtgggaggaaccaatctgcagcgcagccacccccaaggctggatccttaagtgaaggaccaagccaggcctcagggtgactgtgatcaggactgaggggtggacaaggtggcccaagtatggcttccagaccccgaagccccacgacctcccaggtgcccgccatgatgaccctcaggtggcagtgaccccgtcactgtataagacattttctcctgctgagcagaaggcatcatcccctgcaactacctcttcccacgtctttctcccctggtaccaaaaagaaccctgtacctctcctcctcctcctccctcctgccagtgcagtggccttggtcttggaaactgaagggagaaggtctggcccccagggtggggctctcctttccctcccccagccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtgactgcaaatgcttctttccccagctcttggggacctggccctcactcccagcaggaactcccagcaaaacttcccagccccacacagcagggctgcactctcccagggcccgggggaggctgagaccatcctctgcactggaatggccccctgcagggccaggcgcctatagccagctgccccgggcccaagagagtggtgtgggccacggcccctgtattcccaccacttgcagagaaaagctgcttcccctccctacccacccacatggcttcaggaaag

SEQ ID NO: 9795 - DNA, 2060 bp, Homo sapiens
tgggccctggagacccacaggagggtgaagagacctggaacagtccctgtcctcccagttgcagctgggggaggctgagtagagccacgaactatggcagctacaatattgggttgtagagggcagcagggctcagctgggtggccccaggagaggcgaggccctgagagaaaggctttctaccctccaggctttggctcccttggcctgatgacgtccgtcctggtctgccctgatgggaagacgattgaggctgaggccgctcatgggaccgtcacccgccactatcgggagcaccagaaggtgagtgcagggcatggggcctcacaatgcccctctaccccaggggcctaaagcccactgggctgagggctggaaggacgagcctgacccaccagcccaggggcgggcagctgtatctgggcagcctcctcactagctggctcggctcttgatctccctgcaacccccgtccccagggccggcccaccagcaccaaccccatcgccagcatctttgcctggacacgtggcctggagcaccgggggaagctggatgggaaccaagacctcatcaggtgagcatggagggagaggccggagctgcccaggacaggctctgggtcctgcccttgcacagatggggtctcattctgccccatccccataggtttgcccagatgctggagaaggtgtgcgtggagacggtggagagtggagccatgaccaaggacctggcgggctgcattcacggcctcagcaagtgcgtggcctggggtggtaggcagaccctggggccatgtgggaggaagccaggggacccctcctaaagtccccctcatgagtcagcttagctgcaagggggcctggggcaggacatgtccacagccctgagagactgctcaggccagcctctgtagaccaggtctagtgagttcctccccatccctgaggctggctactcagagctccttccgaccctgcccacacccctttcccagcttctctcaggagagcagttacctggcaagacagaccctgcgggtgcctgccgaatctcggtggcctcatggtagggggctatagctggcctctggcctgtagtctgggtggcaggagatggctgttctgatgcccaagctcaggctgttccctggaagggcctggctgatggccttggcaaggcctggagccacccctgatgtgagtggtgctctctctgcagtgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattg

SEQ ID NO: 9796 - DNA, 1118 bp, Homo sapiens
caaagcaaagttgagagggagaggctgggccagcagaaacatcgtgtgcactgcacggaggctggtgttaaacagtcgcgtgggcggcggggtaccgttcctggagagctgggccttgccctgggaggtgggaggttgccggcaatcgccaggctagggcaccacgccagggccctgtctctccccctgcagtccatctcaggttttgcgcacagctgcttccagtatgccatccagaagaaatggccgctgtacatgagcaccaagaacaccatactgaaagcctacgatgggcgtttcaaggacatcttccaggagatctttgacaagtaaagcctcatccatgtactctgtggcctttcttcccttccccccatgctgttcccatcctaccctgggaaggtcgctattagagtgcatttggctcagctccgaggctcagggagggatccccaacctgtcagccttctgccctctccccataacagacctttttactcccaggcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggtacgctgggaggacgctgctccctgtgggggtggactgttggtcttctctggctggagggattttcagacccttttggtagaaaactctagtggagcaggactcattgcagggtcctctgtggacagcagggggcaggagctccctggcatctgagtgagagaggatcacaaattaggtttggactggtgtatgactgaggctgctcttagagagaaaggagggcacaggaattccagggctaggttgacagccctaaggttgctccagtccatgatggagcctcatgactctttggttccagtaggaaaatgggatcaagcgggactggaggttctttaaactacagcgaatgcattttgcatagtgaacctaatggatggaagagaatgttggggaagcctgcaaacccccaagccctagggtgtcctaaaagacaaatcagattgcagtaaaaagtat

SEQ ID NO: 9797 - DNA, 1104 bp, Homo sapiens
caccattaaaactggcagacttgctgggcatggtggctcacacctgtaatcccagcactttgggaagccgaggcgggtggatcacctgaggttgggaggtcgagaccagcctgaccaacatggagaaaccccatctctcctaaaaatacaaaattagcttggtgtggtgtcacatgcctgtaattccagctgctcgggaggctgaggcaggagaaccgcttgaacccaggaggcagaggttgtggtgagccgagatcgcgccattgcactccagcctgggcaataggagcaaaactctgtctcaaaaaaaaaaaaaaaaaaaaaaaaattggcagactccagagcccacacatttgcactctagactctactgccttcctcatgaagaattttaggacccccgtctggctgtgttgttgcttggggttcaaattctggttgaaagatggcggctgcagtgggaccactattatctctgtcctcacagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccaggtaggccagggtggagaggggatccactgacctgggcaccccccgactggagctcctcgcctagccatcctcttgtctctgcagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgaggtgaggctggcttgggcatcctgggcccctcctctcccagcttgtctcttcatctctgtctcgtggctttcctttcttctgtaatggcctcattcttaggccacaaagaggcagaaatggccaccagggctgggcatggtggctgacacttgtaatcccggcattttgggaggccaaggcaggattgcttgagaccagaagtttgagaccagcctgggcaacagtgag

SEQ ID NO: 9798 - DNA, 1207 bp, Homo sapiens
cagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaatcctggctcttcctcttcaaggacagttgctttttgaggtaggtctagtcttctgagttctgagaggttctgaacctcttctt

SEQ ID NO: 9799 - DNA, 1203 bp, Homo sapiens
gactagaatccctgtcagccacctatgtggctgctgccacccctaaaaagtgttgtgagtgcaccaaggacaaatggcatgctcttcgttattagtgagctattaacctcttccagttctttctcctaccttggtgaaccggcctgtatcttgtgtgttccgagggcccctctttcccctctagcgctagacccagtttgcctttttggtttggttccatcctgtttcctccataacctccacccctcccaagttggaggagccccaatatctgggatttacagtaactctaaggccaggaataaagatcatagagattggagggagaaaagcttcccctcttcagttctatttataatacctctacttctactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtgggtttgtgtttccctgaaaggttaactgggaaaatttaggggtaattcctataaatgagcactgggagtggttgagaaatagaaaatgtagagatttctgcttttcttcattgtttggagagcagcttcaatattgaaattaagccgctgttctaatgagatatcacctaacgattcaaggctttttgctaagggctgcacaatagatcaaggatacatcttaaattattatttatgcttaaattgaagcttatttttatccttttgcctgttcttattgagttttacatttgtttaggctaaggagcggggttttttttgtttttttgtttttttttgaaacggagtctcgctctgtcgcccgggccagagtgcaatgacgctatctcggctcactgcaagctccgcctcccaggttaacgccattctcctggctcagcctcccgagtagctgggactacaggcgcccaccaccacgcctggctaattttttgtatttttagtagagacggggtttcaccgtgttagccaggatagtcttgatctcctgacctcgtgatccgcccgccttggcctcccacagtgctgggattacaggcgtgagccactgcgcccggccggctaaagagcagttgtata

SEQ ID NO: 9800 - DNA, 1082 bp, Homo sapiens
tctccccttccttcctagaagactcttcctctccttttttcctgagttcaagcatcccttcgttttggaagctttccttgctttttccattctgagttgaagccctttccctatggtcctgtggcacttttggtgaactgatttacagcacaataggtttataatcatctgtttgtgtgtcgctcccaccagactgtaaaagactgaagagaaggtgtcatgtcttgtataacttttattcccaagtgcctgttattgtgcctggcacacaattcaggcacctgattcacagttaaaaacctgcgttcagattctagacttatcacttaccagccccgtgaggatgagcttaagctatctaatatttctgggtcttatagtttatgaaagataagacacttgcttcaggctgttcctggctgttagtctaacatagttgggtataatttctgtcttcccagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccgtgagtgccatcagttgtcatgacccccagtagaacccagcactaagtgcctttctgctccttggcccttctcactaagttttgtccatcccgcagttatgggatgcgcttcattgccaaagtgctgaaggactcgttgcatgagaagttccctgatgctggtgaggatgagctgctgaaggtaagaatctcatagccggcagactcctgccctttgaggacaaagcaataaaaccagggctgaccatagatcattactaactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggc

SEQ ID NO: 9801 - DNA, 1228 bp, Homo sapiens
ctctaaaggaaagaatttttttgtttgtttgttatgagacagggtctccctctgttgcccaggctgaagtacagtggtgcagtcatagctcactgcagcctcaaattcctaggctcaagtgatcctcctgagttgttttttttttttttaatagagatggagtctcactatgttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatcttatatttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaagtgagtatcaaaagaaggaagaatgaaatgaatgtaatctgaaggtttcttggcctttggagaggaacctgctgggtcctacctgaaatgaccatcctgacctctcgtacttgtcataatcccagtcaccaatcacctcgcatattgtacttggtacaggacttatctgccttattttgctaatatgctacagtgaaatgtaaatcttggaaatcctaaccctcgtacctacttatggaatggctgggtaaataagccttgtgccttgagtactgtgtactggcagctgccgcttgggacttctgtgaggtactgtttgtgctgctgctgctgctgctgcttcggtccacttgagaggaactagaacactggtaatatttaaatgcctcccccatctcgtttcagtacaaaacgtttaattgtggatgtcatccggttccagccaggagagaccttgactgaaatcctagaaacaccagccaccagtgaacaggtaaaatttagggtctaacatactcctttgtttggtagataagctctcccgataggcgcatgtcagagaa

SEQ ID NO: 9802 - DNA, 2193 bp, Homo sapiens
catacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgtttgtgtttttctcagtttcattgttaacagttcctgctaaacaccttgactagagtgagatgtatcagttaaaatcacaacagcagacaaccccttccttttaaaggagaaaacgtaagtccaccatcagatcattgaatgtctcaaagtgacttttaatgtgtgaacgtgtgactttagcctttttaatgaatatgcttaagttatcttcaccataaaaagaagggtgttgcgggaagcaaacattatatgtcacttaattctgattgacgaacggtggaaagtttaaaattgcaacagcatttaaccttttttgaccagcatactgttgttgagcacatagactgtgccccttagggggttcctatgtcacttggaagtcaccagaaaagactaggggatgttgaatgtggaaaaagtaaatcacagcagtaaaaaaagaagaaaaggggctggcgtagtggctcaca

SEQ ID NO: 9803 - DNA, 1207 bp, Homo sapiens
gagacgggatttcaccatgttggccaggctggtttcaaactcctgacctcaggtgatccacccacctcagcctcccaaagtctgagattacaggcgtgagccagcacgccagccttgttatcttgtttcatccataccctgcttttaaaaattgcagatattttaatatgtatctctaatagataaggattttcttagtagcctaaatattgtcatgctgattttggtttttcacaactacttcttcctgcacacatctttccaagattgtgtgtgtctgctctggcctctgactttcacggcagatggtttcctcagggcctggtgatcctcagtgctctgctcatgtttaagaacaggacactgaggggctgtctccttgcggctctacactagagcggagtatgagactgaggcgaagggagtcatggcaggacaagcgtgtagaaagttttttccactctctgactgagtattggttggaaggagcgctgctaaaactgtaaccaaaggaggcattttgcttccagaaaaatctcaaggaaaagtattgcaagcaacagtagtcactgttggatcgggttctaaaggtaaggctggagagattcaaccagttagcgtgaaagttggagataaagttcttctcccagaatatggaggcaccaaagtagttctagatgacaaggattatttcctatttagagatggtgacattcttggaaagtacatagactgaaataagtcactactgaaatggcatcagtgtgaagctgcccattccactgaagttctgaaatctttcatcatgtaaataatttccatatttcttataataaactaatgataactaatgacatccagtgtctccaaaattgtttccttgtactgatataaacatttccaaataaaaatatgtaaatgagaaaaaaaaaaggacactgagaagctggctggcagctctgtgtatgtgggcaggcctgctgagtgtggtcttcattgtagaatgatctagcttggtcatttccttgggaaactcctggtgtcataagttttacattcttctctggccaggcgtggtggctcacacctgtaatctcagcactttgggaggccgaggcgggtggatcacctgaggtcaggagttcgagaccagcctggccaacatggtgaaaccccgtctctactaaaaatacaaaaattagccagg

SEQ ID NO: 9804 - DNA, 1209 bp, Homo sapiens
agcactgtgtcatagtttaattagcagaattttttcttccttaatagtccataaaataacagtatcttaatatagttggcatcttagatccaatgaaatattgtaatgaccaattgtaatattgtaatgggctgggggccgtggctcacgcctgtaatccctgcactttgggaggctgaggtggacggattgcctgaggtcaggagttcgagactagcctggccaacatggtaaaaccccgtctctactaagaatacaaaaattagccaggcgtggtggcgggcgcttgtaatcccggctacttgggaacctgaggcaggagaattggttgaacccaggaggtggaggttgcagtgagccaagatcgtgccactgccctccagcctgggcgacagagcgagactccatctcaaaaaaaaaaaaaaaaaaagtctgcaatgaagagctagtttccttatgaagagattatgttttatgcttctttgaatctggatctagcacactgctatgtctttagttaataaatacttactggtctgagttatttccatgggcagatagcccaacccagaatttcagtagtagagttcctggaaaacaacgtcttcatatagttggccagctgggctatattaccttccatattcttcttcataaaatctcataatcatcaccttctctcttcttcattccctctcctacgataatcggtcattacaatatttcactgactctaagatgccaactatattaagatactgttactttatggactattaaggaagaaaaaattctgctaattaaactatgacacagtgcttttattgaaaaaattgtgttttactgatttagacattgatttttattatccacagctgtgtgcctgtatgaaaaatacatataatcaaattaccgtaggtacttataaaagttcacattcaaagcctgactcttctgagtcactttttgactgagtcgtccatgtctttgtttttccctatgtcatcactaacattctcattagccataaggcatttccagagtgttccactattttccccaggatttaatcgaaatctctgttatcagttctgttttgaaggtggtggtttcttgatgataccagaaggtgtcaacagaaggttgtacatctctcagtaacaaaaatgtagtgcggcctcatctactttgggcatcttctttcttagg

SEQ ID NO: 9805 - DNA, 1151 bp, Homo sapiens
agctggggccccgaggatgacggcaagacagtggatgggccagcccgcctcgccgaggaggccttcttccgtggggttagccaggtgaggtggggatctgtccagcccctgcgggcaggttgggtgctgtcttccgtacctatcttgtgttttttggtttgttttatttattctcatgtttaactttacacaaagcatgtttattgaaacattaagggacagaagaagagtagagtgcatataccacttggacttgcctaattaaaaaacacattttttttagaaatgaggtcttgctgtgttacccaggctggtctcaaactcctggcctcaagcgatcctcccgccttggcctcttggtctgattttttgtgtgcctagatagacatatttggatacatacttgatccaccagggatctcacaggggacaggaggttcccagagaatgaggctccagccttcccagttttccagcagtgtcctcctgccagccctccctcaagtcccaatcttgaatgaccccagcccactctgtccacagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgagtcttacctgggggtgggggctggggagatggggctgctggctggctctgtccagcaccctcttttggaggctgtctgcctccacccccatgtggctgggtgatagtggctcaggcatcatgcaacatgaactctggggctctgtaggttcttggaggccatggagccatctctgaagactttgaaaagcctagactctctctaaaaacatactttgttcttattcatctccaccctctagttgaacccccttattcctttggaaaatgaggcccaggaggggctcgtcattagcatgtccacggcaagttagcaaggcagcagctgggacctggggttcttggccctggctccccataccatctgtggtgcccagggcctgtatgcagag

SEQ ID NO: 9806 - DNA, 1785 bp, Homo sapiens
gtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagat

SEQ ID NO: 9807 - DNA, 1473 bp, Homo sapiens
catcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtg

SEQ ID NO: 9808 - DNA, 1176 bp, Homo sapiens
ctccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccatttatatcatagcagaagaaataggattatcaatgtgaactgcttagcatggtgcctggtatatacgagagctccacaaatgtgagctataatcctactagtaaaggatgctaagcagttccactgtggcaggtgtcatttgctagtagaatttgtaatcaaacaataggaggggaatctgtgaacgcctagaaaatgagcagaataaaggatattatctttggaagtcttagatgtgcaatgaaattatttgtctgacagaaacgaatgctgaattctatttacttaagcctttaaaatgacttaaggcagtccgggcacggtggctcatgactgtaatcccagcaccttgggaggccaaggtgggtggaccacctgagctcaggagttggagaccagcctggacaacatggcgaaaccccatctctaccaaaaaaatacaaaaatgagccgggcgtggtggtgtgtgcctgtaatcccagctactcggtaggctgaggcaggagaatcacttgaacctaggaggcagaggttgctgtgagccaagattgcgccattgtactccagcctgggtgacagagcgagactctgtctcaaaaacaaaaaaacaaaaaaaaaaaacataaaatgacttaaggcagcatggctcaaggtgtgattcagaatcaccagaactgccattgaaagtacaggtttctgttctgactagggcttc

SEQ ID NO: 9809 - DNA, 1570 bp, Homo sapiens
ttaaccaaacttagaagggtgggccatgtgtaagagaggcagtatggccactgatgttatttatttttcaacagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaagatatagtgtggtgtttcctttttttccccagtcactttttagttggttggtctgtgtgtgaaaaacaaacacaaaaaactaaaaggacctcctggaaatttttagtcaggagtgtgatttttttttttgagtctcactctgtcgcccaggctggagtacagtggcactatcttggttcagtgcaacttccacctcccaggttcaagcgattctcctgcctcagcctcccgatttgctgggattacaggcacgcaccatcacacctggctaatttttgtatttttagtagagacaggctttcaccatgttggccaggctggtcttgaactcct

SEQ ID NO: 9810 - DNA, 1267 bp, Homo sapiens
gaaatttgaggaggctgggtgcggtggctcatgcctgtaatcccagcactttgggaggccgaggcgcatggattgcttgaggtcaggagttcaagaccagcctgatcaacatggtgaacctccgtctctactaaaaataaaaaaattagccgggcatggtggtgagcacctgtaatcccagctactcaagaggctgagacaggagaatctattgaacccggaaggtagaggttgcagtgagccgaaagcacgccattgcactccagcctgggcaacagagcgagactccatctcaaagaaaaaaagaaaaagaaaaaagaaatttgaggagtttggtattggtgttgggagtttttttcctccattgccccaaacttatggactgttttccctcttgtaggaactcctggatatgatgattgctgaagaggaaagcctgaaggaaagactcatcaaaagcatatccgtctgtcagaaagagctgaacactctgtgcagcgagttacatgttgagccatttcaggtccgtggcagcccacagggtctctggtgatctgtctggggcctgagacttagaaagcaacgttgacttgggcctgcagatggaaggcttcctcgtagggatggagctagacgtaagaagtggggaaaacatgctgtgtagttaattaggcccagcagagtaattctcacctctgtagagagttgccctggtaagaggtgaagcaactaatagatgatcaaaaagaagctgctgcttaccatagttttgctttgtagggaatatgaatttttttttataaacgctgagaaaaaggtaggcatagatggtgctgcagtgttctttctctgaaagaaaatgaaaacaggaacaaaagtaactaatgattaaaaggaatactatgaaaacaccaacctttgtgggttttatcatacccagaagctgcataccactgaaccagccaaaatggcttcttcagaagaaatgtctcaaaagctggaatactgggagtgcatagtccatttcagagcatgccatgacatccatctgggtatggagctgagaagtggctatattgtggtccactgcaagtcagggacttgagtgaggacacagcaaggatgaaatgaataacagatggggtcctgaaaatctctgcttagaaccagtaaaaatagtgccaggatcataaaaattaggacagatgtggagcttggaaagacaatgagtacacccataaggttctcaggtccctcttcctgttac

SEQ ID NO: 9811 - DNA, 1261 bp, Homo sapiens
acgaatagacccacaagctcctggaagctgtcgtgtgtccaatgcgtgaaaatgtctgtgacattttcagtgttagtcttgaactaaggcccttgtctgtgtgttttgaaggtgggtgaacctcagagaatgaacctgttatgatttggggtaagaatcacgttggaaaacctctcgcaaccagcacactaggccttctacggccatttctgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtaccgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccacttcataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatg

SEQ ID NO: 9812 - DNA, 1162 bp, Homo sapiens
tgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaaccatgagtaccttgggcttggatgttttctgtggtgccggccagcggggcaccttttgtgaagacagaggtgggtgggcccaaggctgaggaggagggcggggatgggagctgggctggaggtgtttggatcctggtgattagagaaaagcttggaaatgaaaaaggcttggtggtggaggggcatgcatgctgtttttacgtctacatatacaattggaggctcactcgctcat

SEQ ID NO: 9813 - DNA, 1988 bp, Homo sapiens
tggtaaacaaacagagcaatagaaatagtttgggatttattcctgaaagaggagggagtgcttaattaatgtatctacttttatttaacttcttaaatttggtttccttgctcatttttagtgtgagatataataaaatgagtttcaaacatacttactctaattgtgagagattgatcagtgatttttttaaattggtattctataccaggcttggttgtctatagaatcagacttctttcacctttctcattttgtgtgatatttttgtggattcttattctgaattaggtttatagactagatcctgaagagagattcttttgtctcaatgaaatgtctactttctgctttcttgggaggactttgctagtcttagctatataacgtacttctgatgaaagttaaatattgatagccacaggtcagtgagttgggtgtgggtttttaaataaatgtaccttaaaaatctaattcaccctaacatctgcattacatttgtgatgttttattttgagtgacctctgagctgttttgcctttgcttttgttttccatagtgtctcgcactaggttactgagccatgtttgttaaaaccaatcacatagttgtagaaatctttccctcttttacatattaattaacacattctctgtagggtacaagattaacagcaataggaatagtttgccattttccttaattgtggagagaaagagctactgaaatgtctgtgactgtaagctttccttggcctagtgctgttagcagagcactgttggctcatgagtgaacatactcttaaatgagtctaaaatgaatacatcagtagttggtgcctttaaggcacactgactaaatgttgtggcatttttatttgatagtctcaatctgcagtatccagtatggtccccactactcacatgtggcttttaaaattcgcattagttaaaaataaaacttccatttctcagtcacaccagtcacattttaagcgcttggtagtcacatgtggctgatgggtactgtattggacattgtagatacaggacatttacatcgttgcagaaagttattggatattgctgttctggaagtcaagctgagataaatatttcctggctttagagataactcagtgatagcagagagatattaattttcaaatcaaaagaagagggagttccaccaagcaagtgcttaggtttctttgtgtctaaaagctcatattgaataatggtatattgagtagactgttgatccaggagatagtgttgtcccgaagaactgtgaattaaagtctgtaatcatttttcccccctcacacactgaaggcaagtagcgggtctgagagtgggagcccaaaaagaagaggccagaggcagctgaaaaaacagtaagtctttcatgggggaaattattcaatctagtagtttcaaacttgtcagcatttctaggactgccttcgttgtgtctttagtctactccaggtcccttagtctgcttctgtctctcttactagctcgggtgactgtctaccttgacctgttgcaatagcagcagcagcattggaaactcaagattctcagtttaacacatggaaggggtccacgtatactcgagcttttgcttgggataaatctcagcttcttccatcgggttaacccaattagcccattgatttttttcagaaaaatatgtataaataacaagtacacaggtatttggtattgtagtaagcaaggaacaaatgtagatttgctatttttatggcaaaattatattggctgaacatccattttggtaagaaattacatattgttgtttctgtataattttaatgttgcagttcataagccagaaaaatttaatttgtggacttaatgtggagtttctttataacatagatttatatgttgattttttaatttaaaaagttcgatttatatgatatgaaattatttgattttttttgagaaataattttt

SEQ ID NO: 9814 - DNA, 1438 bp, Homo sapiens
gagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgctgggattacaggtgtgagcctccgcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttctttttttgtgtggtagtctacttgtttacataataatctgatactaaaaaatgaaaaaaatagaagtgtccttatagttttctatatcttgcttatacaaatcagtataaatatagaatttttattttcaaattgagttagactccctacagttgtttaggagcattcatcagcactttaggaaaaaaaagtaagctttgagcctactgtaaatggcagatctataaaacaacatgcttttggaaccaaaagggtatggtttcttattctagtgacggttatgtgtggcagtttaattctgaagagatcatttctcatttattcagcattattcctcttgcagttacaaagaagatgatgactttgagactgactcagatgatctcattgaaatgactggagaaggagttgatgaacagcaagataatagtgaaactattgaaaaggtcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaagcaaatccacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccg

SEQ ID NO: 9815 - DNA, 1264 bp, Homo sapiens
aaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacatttaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaa

SEQ ID NO: 9816 - DNA, 1103 bp, Homo sapiens
ttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaacacgttgcattgcattgtggtgtgagctctgtgactagagataccgccttgtctaccttccctcgttggttgctgggtcacatccagatgttttgacagcttgtgaagtggagtcttttaaagttgcatttccctccatccagtaccagttgcattgttgcgtaccggccttaacaccacagatacctaagctgttcctgagtatgccgtcgtcgaggtgaacagctccctggccgagcaactccaggctgtggcccacagctctgcacttgagggagggccagggttgccgaaaccggtagttaattcccgtgggttagtcctgcctggggggatccagggagacctaggggggccaccccttctatcctgaaggaaataacactgtgtctgcc

SEQ ID NO: 9817 - DNA, 1172 bp, Homo sapiens
gccaacaggcatagcctcatataaaaaatgggggaaaaaaaacatttattagcccaagaagccaatgggttcaaggtcactcccaacatttttatgccatcaagtatatcagctccaaaagaggcttttcctttgccattggggggtattttgtttgctgtcgtttattttagttctccactgcttcggtgtagaggacctatgctgcctgtaggcttgacctttcctatactttttctgctgtctgaagttgctaaaacatttggccttaataaaaacactaataaaggttttattaatctgtatccgtcattgtctcagcatttgtttatccacttccctttctcacgttctcctcagctggtggcttcatgcgttgagttccccttcaacctccccagctccacttcccacccgaattccctttcaaaactttccatggaatgttctatgcaattctgggcaaaagaggaaagtgaacacaattggtggcttcttccagtcagcacccagacagccactgtgaggaggagaggatttcctctttctcgagtttagtttctggcactgtgattttagaaaaacagagatctgttgccctggattctgtagggagatgacagaaatgattaatgggctgctggcttgatctgaagaaagattagaacagatgaatagaaataggttgtctaatagaggggacttctaaacaggaagggaggcttagaaatggagccacttctccacggccttttctctgagggattcctcactgctgagcttcatgcctcggagcagagcccgcccccacgctggagaatgcaggctgccatgttgtactctcagatctctgaggcccacagcaaggaagatcaaggtggtgttctccttgctggttttccaaagtatgattttgcaaggatccatgggtatatgcgactgtgtgtatagggacatttctcattggacaccattgaaaaaaatgcagagccagttagatacgctatatacctacagcctatcatttggttgtcctgaaagtactggaataaaagtgctcacttaaactcgttttcagttttaatttaaaactctacttccaaaaatttagaccatgtgtatgttgactggccttggtgattctcagaaataccgcagccataacgtggtgg

SEQ ID NO: 9818 - DNA, 2625 bp, Homo sapiens
atggaagtcctgatggttacagagtaagtgaaagggtgcctgcgctgacgtgagagaaaggaatctgtaaacagtggaaacactgtgggagtttcccatggtgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacggtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtaagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcactaaatatgaaactgggccaaggggaaaattcagtaagttagcgttaaatggaagtaaatatatgtatacctaagagaatgtcaaaataaacaccaaaccaaaagaaggtaggagtgccatttttagaaaagacacaactttaattcctgtcaagagacctaggtctactgatggcagtcactgcattgtacattattccagttcttcagtaattctgtttaaactgtgattttctttattgtgttggtgcaatattttattatcatttaacctcaggatattcagaccaacaggattgtgttgctgctgaaagtctgagcagtgttttaccgtccccagcccccctcccacatggtcacatgttcacttgcttttccttccatctgttggttttgtgagctgagagcatctctggacacatggaagggagccagggattcctgtgatacagattttgaaccagcagagtactttggttttcttcatgtcctaagggtttgatccagaaaccctggtgcttcccctgcagaatactgtacttcatttaacagaatgattgatttttctttcaatcagcatgttcaccaaaaatagaaaagttcttctaaggttaaattttgtatttaaaagttagttggccatttgatcagggaattttctacacacattaggcaaatgtatgcttttcatcctctgggcttacctctctcctctgcaatcctggaagcatcgtgcatagttctttcattgtaagccgctatttaaattcccacaatgcaaaactgttagaccagtaattgtgctactgaaattgtcacaaaacgttattccttgatttggtttttaaattttgctttcgtgtgtgtgtctttaaacaggtaatgtgtatttaagtgttgtctaaacagttgatttttactttagaaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggacttaagagaatagctaaaaggtgtgacttgccttattgaaatgatactggcatatctgactgtaagcagtaggttgaagatatcattttatgaatgtggagaattctacattgaaacagaaaatacctgggaatgaagattaaaaatgtagctgctgttatttgcttggttattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgcttgtttgaaccctatgggttcgttttattaataaaattattacactaatgctatgaggtgctagttttttttttcaaatataaattattatagacttaagggaactcaatgccaaaaaaacaaatgttgctgcagttgaaatccttttctctaggtgtgttatcatgagggaggaacagccctagaacctgactttgtttttacagtgggctccggttcccaaggtagtccagtgttagcattccatgaagaaaagtagctgagacaagtgaggaaa

SEQ ID NO: 9819 - DNA, 1227 bp, Homo sapiens
ccaagtccggctgaaagagcttcttaccacatctggcatgtagaatggcagaagactatttttgctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttgtggaataatttttaacatttctatttagcattcatgatactctaaatagaagcaggagaacactgtggctctcggatccaggagaggcaggccacgagggctcctgctgtttggggacagtctgtaactctaaatctttttatatgcagcaattatgaccttaaaaatgggtgactctaatactggcattcattgcctaaaaataattttaatgtgcaaatgccagagaccaggtcatctcagaaatggactagaattgaccactgctatgttttggtgaaacctgataaccttgcttttctccgtgtaccttgtttttcattgtaaaactatttaattatgaaaatgagagtgtgaaaggcaaagtatgattgaatttagggggcagttccatatagttgtaacaaactgattatcaaatgtccaccattagtatgttaaaatacggttttctaatactgagacaacagggatggagcagcctatccactgaagtcttgttgtttgtccctgctgtgtcccaacctggaatctctttcttcttccttcagcagacccttcgagatcagcttaagcttcactgccttagagaaactttcctgtctacctggactgtcttctagatttctagagcagtgttcctgcccttttcctttctaaatggggtgggagttctcagagaactcatctcctttatggctttatccatcacagccacacagataggttctgtctggaccatccttttccctgagctttcttctcctttgccatgtgttttcatttctgccagacactggcactggggaa

SEQ ID NO: 9820 - DNA, 1174 bp, Homo sapiens
cctttttcccgacccagcataagaactcttccctctccctactactctcctcctttttacatttgcgttttaatctgttggtgaagatgggtaaaatcctgcttgaccatttcattcagtttctcaatcccctgtggttaatttgtttttttcaaaaatgtgtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacatcaagccatgccatcgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtaagagaaagttcctgaaaagccaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcatcagcaagggccacctgaccctctgagtctttctctttttgattcctcccaggtgcgattgctgggtgtggtgtcccaaggccagccaacactggtcatcatggaactgatgacacggggcgatctcaaaagttatctccggtctctgaggccagaaatggaggtcagttttcatttccaccggtattgcatgttgcctggcctgctctcttttcctttataatctccctgcaaggaaatgc

SEQ ID NO: 9821 - DNA, 1131 bp, Homo sapiens
gtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccaccc

SEQ ID NO: 9822 - DNA, 1110 bp, Homo sapiens
ccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgct

SEQ ID NO: 9823 - DNA, 1126 bp, Homo sapiens
cactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttac

SEQ ID NO: 9824 - DNA, 1210 bp, Homo sapiens
ggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgc

SEQ ID NO: 9825 - DNA, 1193 bp, Homo sapiens
gtgacagagtgagactctgtctgaaaaaaaaaaaattaaaaaaataaaagatgggaggaaaacatctcatgttttatgctctgtgctacaattctcctctcatttatagcccctaccaagtcttctcataaatgggtctgggcacctgctgggcagcaaaggctggatgggaacggtgtggggggctgaggggcaccacactcaccccaccctctgcttgtctgcagggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccac

SEQ ID NO: 9826 - DNA, 1218 bp, Homo sapiens
aaagacattctaatttctactccagaaatctgtttagctcatatgaacaagttgcacttacttcattgctattattcataaatctcctattttcttcttagatggatggtaaaatcacacaagtggcaaaaaccaggttccttgaaatgactgtaattgttcttttctcaccctggcaacaaacttgactcatcaagatgcagaagccatagtgacagacttctggttcagactcaccactttgtgtctctttttttctccatgctacccagcccttttctccatttaagaaatgttggcagggtaatttaaaaacactcacctagcttggattatttgcattttcaccaaaaatcctgcacttcagcattcatgtttatgggaatagtcgcagctactgatttcatttggttaaactgttataatattgattcattttgtttatttcagttcataaggatgcaatttatcctaattttgattttggttgtagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttggtaagtgattgtgtttaaagtaaagcagccaaagaataagatggaaagcctttgtttctttgactagaaccaattagttagtttccttccttctgtttatcttgacgattgcttctctaagtttgtttttgcagtgaacaaagcgtcattcctagctaacaaatggaatttatttcagtgagggattttatactttaaaaaagaaatctgtgctaaaactgtgtttagggataaaatatatgagatgatttcctcagagaaaggaattaaagagtgtgtgtgtgtgtgtgtgtgtgtgtgtgtgtgtgtgtaaggtattgaacaatatgaaaagatagctagctacgggtcttaagtattggcttagatgttgacttctccctagaaaaattggtattgggtatcctaataattaatattgccagataaccagattataaaactttaaagaccttaaaattggctgaacttcctgctgagctagaaatgtcagcctggctaaaaaataatatattatc

SEQ ID NO: 9827 - DNA, 1222 bp, Homo sapiens
tcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattat

SEQ ID NO: 9828 - DNA, 1110 bp, Homo sapiens
ctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaacattgacattttattttccaggtattgtttttccttaatataaattatgtctcaatgaggtaatagtataaaatcatcaccataaaagggttttcttttttttttttttttttgagacagaatctcattctgtcgctcaggccggagtgcagtggcgtgactcgactcactgcaacctccacctcctgggttcaagcaattctcctgcctcagtctcccgagtagctggaattacaggtgcccgccaccacgcccagctaatttttgtatttttagtagagacgggggtttcaccatgttgccaggctggtctcaaactcctgacctcaagtgatccgcctgtccgccctcccgaagtgctgggattacaggcatgagccactgtgcccggctgggttttctagacaagttcttactttttgccttattggaagcaacctagtgactgaaaaagagacatcaagtgacaagtcactcattatagctatataccactggagatttatggcagttctaagtgacacaaaatcgggggtggtgattgcgttcctcagctagggctgccgtaa

SEQ ID NO: 9829 - DNA, 1224 bp, Homo sapiens
acataatgaatagggagaacagatattttcagaaaaatcaaccgattgttttttccagaaacagaacagaaaatgttcagaatattttcaaatttgtcagattcttttatgtttcctttgaaatttattatttaagcctattactaaacctttataaaaatatatttggcaaatacaccaaagaaaccagcttacaaaagattatgatcattaatgaactgcaaacctcatctttcgaaaacaaggttttgtgtttttttttttttgtaaatatttgtgtttataaatgtacagcagagtaagagtgttttttagattatttaattcccatatttctaaactatttactacacagtaatccatgcctgttagtttggaggacttgactgtctcattttttaattcattgtcagtcatgcttggaacagcatttccactagagaatccagcgttctggcagtagcaagagtacacatctggagcatgagggactctagcatgactcgtcagatgcacaccccaagagacaagaatgtgtagtttaatgaccggcgtggaccatacgaaattgagattctaactttcctgcaggagtgctcatgagcccagaatgtgattgggataaggccatttgcccacaaatttagctttcatgtaactcctagtgtgttatatcataatgtattttgttcttcctttttaatgtaagttttgctttgggtcaatttgaattaaaaaaatcaaatctgatttaaaacatgttggagttgtattttatttccagtctaccttaagtttttaatatgtccagctatttggtgaaaataaataaaactctatccttccttcatcagcattttagatcgctgggagttgtttaagaatatgatgatgtggaaaacaataccactctccattgtcaccagataagccatttcttaccctcctttaatttgttcaatgcattctgcaaatacccaccaacaaaagatgatcacagtgttgagtgtatcgacccagcactgggccttcttgggccgtaatcgccacctgccccgtgcgtgccacaccttgactcacgacagggtttagaccacagcgcttctaaacgtaggacagcatgcagtcaaagcaatgcatctgacggagttaccctgcaggagatgaagcaaaacaactttgatttcacatttcctctataaaacataagcacagcttgattca

SEQ ID NO: 9830 - DNA, 1735 bp, Homo sapiens
tccacagattctaccttttgtgttttgttttttttttttacaattgttttaaagccatttcatgttccagttgtaagataaggaaatgtgataatagctgtttcatcattgtcttcaggagagctttccagagttgatcatttcctctcatggtactctgctcagcatggccacgtaggttttttgtttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacatacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacgattcataaagtttttcaagttatttgagggaaatgcttctgtggaccgcagcttgggagtgaaacgaaacccggtttcaagtgcttccttccgttttttcctcagatgagctcgtccttgttcctcatcaactcgctgaccccacgttcttcaaaacaaaggtcttcaaaccgggcctgggccgcgtctggctcctggatagaaatgtcccctcccaggccccatagaacctgcattttaacaactgcctggcgtggggctgtggcacaacttggggttccaggatcaatctagttagaggataaatcagcacagttgcaatataacccaagagtcaaaagaagtgagatctttgatgccaaggtagcaagctcgtgtgggcaagcattgcccccgggataggtatatttacagtgtaatgacagttaagtcccagcataatgacattgcgctcaca

SEQ ID NO: 9831 - DNA, 1161 bp, Homo sapiens
cacttcttcattttttgttggggttcttttgaaagttaatttagactttgcaatacgcggtaacctgggctttcgttaagaggaaccaagcaggccaagtagctttttatcattccattgaacacggcgatacaagatgagcagataacgtgaattcctgaaaatcagcttggaataaactgttctctaactgatatttattttaattccagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgaggtaagaacagaattctttaccatgggaaaaacttaattttgtcaattttgtcattagttctgagcgtatcataggaaactagagatgatatcctctttgagggttgaagttggtattattctacatttttagccttagattaaaaaaaaaattcagttcccctttattaccttttcttggctttgagcgcatatcttctgtactttttctccccccagagagagtcttgctctgtctcccaggctggagtgcagtggcgccatctcggctcactttaacctccgcctcctgggttcaagcaattctcctgcctcagcctcccgagtagctaggattataggcaggcgccaccacgctaggctaatttctgtattcttagtagagacgaggtttcaccatgctggccaggctggtctcgaactcttgaccttgtgatctgcctgcctcagcctc

SEQ ID NO: 9832 - DNA, 1410 bp, Homo sapiens
gacaagtttgactcttgattttttttaatctgttttctgtagcgtgaacagcccttatttgaatgtatgagttttagtaagcactgtgataggaggattcatatacttaaatcaggccctcttgagagagttttttggtgacccttttgcatgtgtttcggaggttgggacaaagaagctgaatgacttttttccccaccagacaatcagttcaaatggcaatcacaatataaaggtttttttttttttcacatagctaaaaggtttttttaaatgtcccttaggatctgtatctttgcagtgctttgcgtgtcactctcataattttattgtggatatacaatgttcccagattttcagatttttatcaatactgttgtgctgcttttctgtcctcccaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacctctaactattacttatttctctatttattattactcacccaaaataagtctggcaagtggcagacagctgccgtgattttgaaagttgacagactccttggggttcatccacaaaattgggtgcttggagtcgagttgccgaattactgggataaagaaacatcgtgcctcaaggttcctcataggctgaccaggtttctacgtgacctctcagttattcccttacgccatgactcatcttttacgctcttgtccagaggcactatcagcagttttggataaagagccaaacagtaaatattttagactttacaggccacatatgatctctgtcacatagtctta

SEQ ID NO: 9833 - DNA, 1254 bp, Homo sapiens
tgttggcatatttccctaatttagagacaataaagtcattgaactgttgccagtatatggcatgtagtaggtgcccagatgtttttgagtatttccggtttctttgcctacggtagtgccatgaaaagcacatgagtataggctttaccttcaccaaaaatgaattattatcaactacaatgggaggcaacaattttgaaatctttgtgacccttttcctttgaaattgagcatcccttccagtacctgccaaagacagactagaccgtccctggacgataagctcctcaaaggcaggtgctgcttttgatctttttgtacctacttcagtgtgtaacaaacagtggccacagaacaaacacttgcatgctaagggaatggattctctaaaattgatactacttttgctttggtggttttctttagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctaccaagttgtgtgtcatcatggtgcatttgcagtgaggtctaaggacacgttgaaattggaaatgcaggagggcagcgttttctcggtaggcttcctgggctggattagcgtctggctcctgcagtgtcatgacacatgccaggaaggccgccttttccactcccacatagcccttctgttagtgcagacttacctgtcgctccggcttctgataggacaactgaaatgattccatttttgaaattgattggtgtgtcccaccaaacctggctatgttttttgtttttttctcccccgcccccaggctggtctccaactctggcttcaagtgatcctcccgccttggcctcccaagggagtacaggcctgagccaccatacccagcctttagttttatatatgtacatagttaacataaaggtcatatggagagtctacaagaacatttgttgaaaggggcgtaagttactcatatttgaagaacactactgtttcattgccatctctctgatcccccttagccacgacagtcttaatcccatcttgttgcatatacttt

SEQ ID NO: 9834 - DNA, 2048 bp, Homo sapiens
agctcctgacctcaggtgatccacccacctcggcctcccaaagtgctgggattacaggcatgaggcaccgcgcccggccttgaaacaatcttcacaggcaccgaagactgacctttccctcttttgcctttcctgatgcggggccccagctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcacaggagcctgtatttctttccacggcacacaaaatgaaacatgagtgctgaccaagtgttaagtggacgttactttaactgtggtttcagatctgtttgatgtcattacgtggaaggtcttcttttgagctttagcaaatgttgatgtaaggaagcaatggaggaaatcccagatcccaaccccagaatgtcactgggcaaagagaccccttcagaccacgttagcctcactgggaggaggttctagagcctctccagatgtaggggccccttccatctgtcacgggggagctccccagagcccagactgcctcttcaccggttgctgccaagtgtgattgaattaggttacagcttgtcttctatgcagtggctgaaatccctgaacccatggctgatgcactccttgggatgtttaccatggcctctctgtgaagtcagaagcttgtacttgctaggaatcctttggct

SEQ ID NO: 9835 - DNA, 1128 bp, Homo sapiens
tggagatctgggaaggtggtggaggggaagggaggggctgcctcgtgttggataagggccctcccaccagaggtcaggcctgctgttccctgtctagtagaaggctgcatggaggtgctcctgtgccccacaccgttctgctcacctatcttgtaccccgtcctccagatgggaaaccagatgtctctctggattcctcccaccagcctctgcatgcaccgaccacagccctgtccgaccagcctctgggtctttctcccctgccacccagcccatggccacagccgaggccgggcctgctcactcatactctcactggtggtgagtgtcctggtgactgcctcactggcttccctgcctcccttccaggccatttcccacacggccatccgtaggattcttcagagccccactgctctgtgctcacccagaacccttcacttttaccacacgcatcttcatgaagtccgggcctttgacattcaggacactttccatatgctttttctttcttctgcacctatctgttgctgtcgttttaacctgggggccccttccttgtgtggtctacccgggccctgcccttctttggcattagccaaagtgctgcttcctgacctgcctgcagccctgtcctctccgagctccacggaggggctcggccatggcgtgcggggtgtctctctccccgctagaccctctggaccacagcgtctcatagtctgcgtctttacgtgactcattttgcttcctgaggccctagtgcagttcctggcactgagaaggtttagtgaatgagaaattgttagaattttttatatcaggacctgtgatgtcctgattccattcaccaaaggcaaatcatccttaagcgtgagtatggagaaaatgctgaccttgttatcttcacttctgctgagctctagcaggtttgtgagcagcaaatatttgtgatgtttctgtatagtcaaatatcgcttatgctttccaccctttgacatctcttggtaccttgcttttgggttctgtgtttcctgggactgagtcttgctgagtgattccagtgtcacctgcagggactctgctctcaaggccaaggcagatgttcagtcatctgtgccacgtggc

SEQ ID NO: 9836 - DNA, 1152 bp, Homo sapiens
gtgaattcagatgaaaagaacacgggattggaaatggagagatttgggttctagttccagttttgccacagacttcctctgtgattttgcaaaaccctactgtaagttttttttcaacttacaaaatgatagtcttttttttaagcccttaatgtatacccagaattttctatacattatttgtatatgagcacctttagttttcacggccacgtgggaggcaggaatgaagtaatgttttacaagtgtggtgctcaccaggtcccacagctggccgtgggcagaattctgctttaattgcaggtgtctctgactccagtcccatgcttcttcccttccagtgcagtgtctacttgctaatgatcacgtctcttaaccttagaagattgttctctgttattcgaatcagtattataggagaataagcttctctcttgcctctcacagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgtaagtactgcagcttacttattctaaataaattcattgtaaactttaagttagaagaacaattcagacttgattattgggaagaaattctgaagaatttttatattcttttatgatttcccttttgagtatgtaagcagaaataaattaaaaaacccaatagacctttccatatcagctcactactgttttagttataatgataactgtcaagccagttgatgtctgctggaaatgcacttgacagaaatgttgctttgtaggactggagaagatctcagtctactagcatatctgaagcaagtctaattcgttcagatggattctgtgttctcaatagtgacagctagtgtacagagggggtggcagtgtctttctgccatagatgagcttttgaagggccagtgcttatctgtggtgagaagatggattcagtaaatgccggaatgcctggtagctctctagaacaaaattaagtggaacgcctgtcttatccagaataaattccagatagtccaaagatgtaatgtgaaaaatgaaaccctga

SEQ ID NO: 9837 - DNA, 1155 bp, Homo sapiens
taggcagaggggtctggacacagtgaggtgcagccccctcccaccaggtcagacccaggagatggtgcaggtgcacagagcaggtccctggcccaggcaggaaggcagctgcaccctccctgcagcacaggatgtctggatgtgtactagggcagagaggacaggagcctagggaggctccacttccaaactgtccgtcccacaggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaactgtgccttagccagagctcctctaggtgatcaacccatgtctggagctagctcttcctccaggacacgagagctgggggcctgagtacgtagcgccaggcccggtgtggatgctggggagaatcatcagtgtgggagccgaaagcccccgagggtggggtcctgcacagtgggccatgcctccaccagcaagatgtgcacaggtgacagggcttctccagcctagcagggccagcccaggccctcgtgccccagatggtcaggaccaggtcacagcttggctatgagcctgtttgcggcttctgtggactgtggtgaggactgggccaggaaaggctcagggtagcctgggaggaagaagcgcatggcagacagaggtgctggggagggggccacagggcacttcacaaatagaaggctgtcagagagacagggacaggccacacaagtgtttctgcacattcttcagggtggccacagactggggggtccaaggagcaggtg

SEQ ID NO: 9838 - DNA, 1102 bp, Homo sapiens
cctgggccactcagccctgcagggccctgcgtgcagccagccttggaggctcccgagtgagcactgggcggtgagcagagggggcctgaccccaagagcctggcagagcctggcgggtggttcccaccgtccacaagccactgtgcaaacaccccatgactgcagatgtggtgctgagggagggccccagttggggtcacctccatgacggggctcagcccttgggaagcagacaccccacacccgtccacttcccccctgcaactcctgagaggctggggcaggtactcccagggggatgtggggtgctcccagcaggcagtgaactcaccccccatggctgcccacttcacccacatgtggtcattgcactgttcactgttgccctgggagggggcgcacatgcagtgggggccgtggggcatggacaggaggctcctcgggatggggtgtggacacgccgtcccctgccacaggcctccttcccatctgcggtgctgcctgctcactgccctcctcacctccgtcctgcagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctgggtggggcccaggcccggatgcagaggcctgcagggcctctgtcaattgtacgcgccaccgagtgccttca

SEQ ID NO: 9839 - DNA, 1377 bp, Homo sapiens
cctgaggcctgggcctgaggaccagtggccttgagccccctcgaagcagcccacccttgtcgttctgctgcccagacctgggcaggcccccagtaaccaccgtatctgggccctgggagctgcagccgcggccccacctgcactgatacctgcgtggctgttttctccaggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccg

SEQ ID NO: 9840 - DNA, 1148 bp, Homo sapiens
caaagcctcctccccactcccccattccccaccaacaatccgtctgcctggcacaggcaccaggtatccccggggggtggtactgcctcctgaccttggaccccgcccgccgtgcctaccctgcttgctcctgggtgaggaaggggcttctctgcagggtcctgggtgaggggtgggccctgaggttcagcagtgcccccagcctccgcgtcggggttttgtgaccgcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacggtaggctggcccctcctgcagggatgtggggtgggagggcaggaccgcgctcatggagcctccccacagttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgagtggccctcgacgtggggtgtgggctccgggggagcagggcccccaagtgcagcctgcgaaaggcagtaccgtgggagaggccggacctggcgttgggcacggcccctggaaacctcacatctcggccgagcatggtggctcacacctgtaatccctaggccgagcatggtggctcacacctgtaatgccttggccgagcatggtggctcacacctgtaatcccaacacttgcaggaggatcccatgaggccaggggttcaagagcagcctgggctgtacaaaaaatcgaaaagttagccgagcgtagtggtacatgcctgtggtcccagccactcgggagactaaggtgggaggatcgcttgatcccaggcattggaggcgttggagtgagccgaggtcacagcactgcactccagcctgggtgacaaaagaaaagaaaagaaacctcatgtcttctgtgatgccacacggagatgcgggtctgagaccccgcaggcagttgtgagggggcagtgcca

SEQ ID NO: 9841 - DNA, 1187 bp, Homo sapiens
taaggtctggaaggggccgccatccccagatgtctgctctatgttagctctgaggtagcgagacccagtgaggagcctggcttctcagagccgggtctgggcagctccccaaggtgagtcgaaggtgagggatgggtctgactccaattcctaaagaccatttcttcattttccagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcagagtctgcctttgtgtctttatctgctttgccttcctagtccccgtcctgcttcgtggcccggcatctggcagggctgggagacgcctctccagcttcctctggagcatcccctctggagcctcctctctgccctgttgtgccgggcgttctccaggcctcgtggctgtggtcctggacaggtctccccacactggtgggttcctttgtttcgggggttggatcctctagctccctggccccgtcttccttctcatttgttttctctggtttttgtccagcgtatcttcctgtagcttcttgagaaaagaggtgctcaggagataaacttgagcttgggttggtttgtactgtgagagtgggatcattttcctgtaagatttttgacggcattgcttatcttctagagctaaagttgttaccatgaagtttaacctttctgactcggtttctttgggaccagcctgagcaacttagtgaaaccctgtctctacaaaaaaaaaaaaaaaattaaaaattaaaaattaaaaaaaaaaaaggaaaataggcaaggtctagctgcgttgcccaggctgtagtgcagtgagtggcaattcataggtgcaagcatagctcacaacagccccagactccctgggcttaagtaatctttccacctcagcctcccaaaattctcggattacagaggtaagccaccacacccagccaagaacagaaaccttttgttttccattttcttttattttgagacattgtcttgctctgtcacctgggctgaagtaccgtggtgcaatcacagctcactgcagcctggacctctcaggctcactccatcctcccacctcctcctcctgagg

SEQ ID NO: 9842 - DNA, 1145 bp, Homo sapiens
ggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatc

SEQ ID NO: 9843 - DNA, 1135 bp, Homo sapiens
gggcttcctattataggcctcagggatgggcccccgggggccgggctgcaagaggacggtgacggagcagctggcacctgctggggtcaccggcctgtggttgcggtaggcgctgagccacggaggtgtgggccgtggtaggctcagggccccgtcctcccgccacctgcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggtgggtgctgcggggccccatcgggctgggctgggctaggctggcggccgtgaccacgcgtgaccctggcccgtggtgtctggcgcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccagggtacgtggcccctaccccaggctcatgccccaggcccacggggagggctgcggttcacacgcccgtccttgtagcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgaggtgggtgggggtcccgggggagggtggcgtggggcagggggagtatgccccagcacctcccctgccccacaactgccattcctgtgcccagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgta

SEQ ID NO: 9844 - DNA, 1206 bp, Homo sapiens
tcattttacattttcatctttattcttgcttaatacgtgaatcatggtttgtcaaggtttcaattggcgtgaccttgctaatgagattgtacagttctcctcgtgctacacctttaagcacacctctctaatcaggtttcttaaaactaagaagcctggagttcggttcggccccacagccgcgtcaggtggtgccgaggaggccgtgccctgggccggcctggaaatgggagggcaggcctggtggctgcatgtgcgtcctgcctcgtgcgggtggggctgagctgggcctggggtggacttggggccagcactctggctgccccttggagaagcatggcccacgcgaggcggcagccaaggagccctacggcgtccaccaccgaacttgaagctgaggtgccccgacctggggccctgtggctgcacctgtcaggccgtctgtgcaacatcccgcagcccacggtgggggggcagcagcagctctgagccgagcctctcctcttctcttccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtg

SEQ ID NO: 9845 - DNA, 1162 bp, Homo sapiens
gtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtccccacgttttgctgtgtctggtggggtgggtctggcagtggcggtgccccgtgccaggggccagtgctgcttcatacccggcaaactgacctctggcctttgttttgcctgctgttccctgcgctgaccgggctgacctgccgcggttggctgggttcgcctcaaagtgagggctggagctgggctggagcagctgggcctggtcacggccattctcctcttcccggtggatggaatcccagctgggctgtgctgagccctcgctcacagtccccggcagcagatggcctggggcggactgtccccaacagcagcaggactccagagggccaggtcctccagtcagtcggcccgctcagcagagccgcctgcacgctggccaatctggtgtctgctatgcccggcccaggggggtgtggacgccccggaggtcacagctgagctggaacggggcactccagttggtacagggaccagac

SEQ ID NO: 9846 - DNA, 1071 bp, Homo sapiens
agggctgttgctgttctcgggttctcgattggtcagcggcagcagcacggggcggctgcgcctgtgggccgtgggggctgtgtcggagctgaggtgcaagggctcaggcgccaggtgagctgttcacccctacgtgttttggctgcacgtgggtgttggtgtccctgactggggcttgcagccagtgccccgcccccgcaaaggccgccctgcagaccggccgcctgctagcccctccaagggacaggcttgggtgtggcctgggcctcactggctgctgtcgagtacgggcatgggcccagaagccccagctccatgggctttctcttcttccaccgggagggcacagccaggtcctgagatgcaatgctgagggccctgcctcggctggggacccagctggctcttgtcatcggccttgagacccattgttctctccttccctgcaccctgaggtccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgagggacttccagcctgggcagaggcggggcagccgaacctggtgccctccctgcctgccggctccatctccaccagcccagatgattccaagtcctgccgtcactggctcgcagcggccgccttggggttcccagcggggaagtcttgggtgtgcacgtcccctcaaagccgtcccggttgtgtctgcacaagcgagccgcctggcaggccttgcaggtcttctcaaactgtcctttccctgctattgctttgcgtttttttgtttgtttgttttttgttttttgtaattgtcaaagaaatcacatcagtccgggcgtggtggttcatgcctgtgatcccagcactctgggaggccaaggcaggtggatcacctgaggtcaggagttcgagaccagcctggtcaacatggcgaaatcccatctctactgaaaatacaaaaa

SEQ ID NO: 9847 - DNA, 1164 bp, Homo sapiens
gggacacacacgggggccggcattgctcctttccgccatgtggagttggccggggccagaggcacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccaggtgtgtggggagtgcccgggccgggggcgggatgggggcctgctcagtggggggcctggcatgggcggggccgcctcctccctctggcctgggtgtgtgtcctcagggcccctgtgagtgctgaagtttccccactgtgggtccccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtgaggagttgggtgtgttggggatggtgccgtcctgacctggcccaggtccagtctccgggctgggggctcacagggtgacggcatggtcccaggtcagactgtcctctctggagacaaggatgggctcgtggctgtgagccacccctgcacagggacaaccttccgtgtgctgagtgaccaccagggcgccccaatctctaccatctgtgtcacgtgcaaagaggtaaagcagccccaagagctggggagagggggcctgggtgctggtgggggcaggcaccatcttggcagaaggcacctgtcggccctcacccactccattcccagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggaggtaaaccatgctcctggcactgtgggtggggccggtacccatccaccccaccgcagcatgctgcgcctttg

SEQ ID NO: 9848 - DNA, 1203 bp, Homo sapiens
agggtgacactgctgctcatgcccccagcgctggttcctttacccacctgagaagacgccagagttccaccccaacaagaccacgctggcctggctccgggacacatacccagccctgccaccgtctgcacggcccctggagtgtaccatccgggctggtgaggtcagtggctggcaggagagggccaggccaggctagaggcccgcagctaatctctgctgcacccccttcctccaccaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacaca

SEQ ID NO: 9849 - DNA, 1186 bp, Homo sapiens
ccagtgggattgagggggctgggtcccccaggacacgggcccagaagagccccacgggcttcctgcatcttccaccgcaccatacctggagccctccgaggggtgtcaggggaaacaggccaccgccaaagccatggcccgccgccgagagcccaggccccacccgcacctcctcacccatccagcctgacccacgcggcctctcctcctccttgccgctgtgtggggcagtcccctgtccgccccaaaacccggccttggtccctggccaggctgagagaattgggcagggagagggcggaagggctggcgatcgcttggagtcattaacgtgatcccagctgactccggtcggcctcaacccaggggtggcgcaggcaccttgcaagcctcgagctgtagccaccctcaggcctgggaagaggcctgggccgacctcacacctcagcccttgcacccggccgggctcagttcaggcctgggcaccgagcttcaccctgggtgggtctcctcaggtggagtctgcagagtggacccagccaagggtcagggtcagcactgggtcagcgactccaatcttccagtggccagcacaccctagacaccccgaggagggagggctcctttctagcctgcccccccacccccacttcacccctccccagcttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagagtgagagagagaaagagagtgagagagagagagaaagagagagagagatgctgttgaatcagaaacagatcaacagcccaaagattttcctgtccctggagtgccagccccaggaagctccagggctgagtggtcaggagccagtttctccagcccctcctccccacaacccctagtggggaggggcagctgtccatttgcccaaagtattaatgcaactgaagctgtgatatttccaacgactgtaggaggaaaaattaaggggagagaggaaaacaaaaccaaccaacccctaa

SEQ ID NO: 9850 - DNA, 1202 bp, Homo sapiens
cagggcagacccacgggccgcccaccccgcccaccacccccaagacggagctgcagcaggcgggcgccaagccggagctgaagctggagggacgccggccggtggacagcgggcgccagaacatcgacttcagcaatgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacc

SEQ ID NO: 9851 - DNA, 1560 bp, Homo sapiens
aagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagactgcggcctgccgggtgtgtcctttcctgccctgtccctggctcccctgggctttgggggtgggagccca

SEQ ID NO: 9852 - DNA, 1662 bp, Homo sapiens
ggctttgcttgttactagttttttattgctagttacaggtatgtctaagctcatataagctccatggttccttcaaaggtttgttgttcatggttcagaagccctggaccttgaatccagccggcattcgtcccccatgtccctggcctccaaccttgctctgccccttcaccctcttggagatgcttttctgtcgggtgtcctcacctgtgaggcaaggaatgagagcagctacttcaccccgttgaagtgcggctgctaaaatgaaatagtgcattggtgtgaaagcactctcagacgtgtacgtggctacttgtatgtataagtgaagtgctgctgagacgttagtgatcaggtcaatttttggcagttgggacgaggggaggcttgcttttgtttgtatagttgagagtggcttgctaaggtgcagaaggtttcctgagcttggctcacacttaggttgctggcacttctttctttgcttcttgtcccattgtgtggcttggagaagcgtgggacttttcattaagttttaatattaataaaatgcaaatttattagaatttgtgctcctcgtgacatatccattatcccactttagcaagcaaatatatcttttttttttttttgagactgagtctcactctgtcacccaggctggagtgcagtggtgcgatctcagctcattgcaagctctgcctcccaggttcacaccattctcttgcctcagcctcccaggtggctgggactacaggcgcctgccaccacacccagctaatttttttttttttttggtatttttagttgagacggggtttcaccgtgttagccaggatggtctcgatctcctgaccttgtgatcctcccgcctcagccccccaaagtgctgggattacaggcatgagccaccgctcctggccacaagcaaatatatctttaagcaaataataagctaagctgtgatggtggcttttaggagaggagtaggaagtgggtctcctttgcatcacagaacttctcggccactgtctgccttggagcttcccgggaaggaaggctgcctgtccgctgctctctgctttcaggttcctcagtgctttgggaggcacttcactgtgcccaggacatcctctgacaccagtctttggagagacctctgctcagtcgttgcttccattacccgtcagaaaagaaggccaggtggtggcagttgccccgcaacagtctttagctcaccttccagaaagatgctcagaggagaatcctcttacattctggagaaatctgcatctggagtggtgagcatctgtcagggaggaaacgatcaatacttcatgtttcaatttttcacttggaaatgatgtaacttctattatgcctaaggaatacttagctcaatcactggcagttcctttggttgattacttactgccctggccagtttcaatctcagtgggcctgagactcttacagtgaatttggaagaaaggacttgtggagaaaaggaaagtctgcttgtttggcttttctgcatgcaagtgtgttttctttctctgaagaagacactcttattgacttcaatgaaaaatgcttttttttctagttcagtttcaaatttaaatcttcttgcattgataaagcgatggtagctgggatttagtg

SEQ ID NO: 9853 - DNA, 1186 bp, Homo sapiens
gaatgttcagtggcttccagcttggctcggctcccacactcccaacagtggctgtaaaggaagccccctgcggccacatcctgctgtgagggcatggcgggcgggctcgacatgtctgcttttgccctcgccctcgcagggagaggttcgttccggcccatccagtcttctctgaccaaagcagctctgtctcggccgatcgtgcccaaggtccttccaccccaggccacgagtcacctggccagtaagtctgtacctgcatggccacagccactgagtgagcctctgagggatgtttttgtgaccaggttttttgaatgttttcttctccaaatcataatgtctcattacccttcaccaagaacatctaagcccttggctcttgcattgacatgaggtgcgagggagaagctgttccccgagccctcttgggacatcttatgggttgtcagtagagcagagatgtgcagcgtcctttttgttgccaggtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtgggggtgagtatgtttagaagggcttttcagcattaccaccaacttctggtgtggacgccaaagccatggggctgagatcacgctggactccagctctgcctttggaggagagtctctggaccaggggtgccatggcataagcaaactctgtgtagtacagagcaggagaggcctccggagccactgacgaaaggtggggacaggcttgccatgtggcactggagaactcagagctaagacggtgtggaaacatagctccatctgagagtgaccataaccaaggtggcagcccacagcgctgtgctcggacaccactgagcatctctttcatctgggaagagagcagcctgtatggccttggccattgctcctttccaaggctctgagcacctggtttctctggcctcccacggccacttcagagctgccccaaggagggtggggtgggctgatgctgttaagactccagggagcccagccctgcctgccacaaggttgacttcctgataggactttacttca

SEQ ID NO: 9854 - DNA, 1374 bp, Homo sapiens
gtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatg

SEQ ID NO: 9855 - DNA, 1261 bp, Homo sapiens
tgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtag

SEQ ID NO: 9856 - DNA, 2836 bp, Homo sapiens
ccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagagcttttgcctgtcagttgtgtgtgtcccttatagtcccttcccccacagctcttgctgaaagagtttgccttgttttgttttgttgttttgtatttagccagaggatgccaaaattagtcttctcaaagctttgagtagagtaagtgtgggaataagccagtttttttttttctgtttctgtaacttaaatgaacgggtttttttcccttgtatgccacttgtcctaacatgtccttaaggtgtttaacctgcctctgacctggcttgcaatgcataggtgaggagaagcagagagcttgtcatatgcaagtcctgtcaagaaaacaggtgggcatggtggctcaggtctgtagtctttgggtctttgggaggccagggtgggaggatcacttgag

SEQ ID NO: 9857 - DNA, 1175 bp, Homo sapiens
caggccctgaagcgggactttgagggcagcctccaccttgctggccacatgccaggggccgtgacctctccctgcacactgcctgcccctccctgcagcggggagctgggctgctttggctccacggtatttggttcaggatgtcccttggcagaggctgtgcccaccaacagtcagggggctgtgctgggctccacggtggcctctgcagcaaggagccgtttcaggcgtctgtccagcagggagtcgctggtcatgcctgtgccccggcggcactccaggtcccggtctgtggaaccctcagtgactgtggcagcagagcagcctctgggtcgagcaggggccagctgtggcctccaagcccaggggcatagccggtgccaggaaagccacccttcccagctgggcacccagtgccgggaaagccacccttcccagctgggcacccggtggccgggaaaaggcgaggatgggcccaggcgggcctccctgccgtgacctcccccaggacaagcctggggcactgtgggggccgctcaccctggacagagacatcacccatcattcttccactcagcgactgcacgtcctccgcccgtcgagagcagaagcgcgagcagtaccgccaggtgcgtgagcacgtgcgtaacgacgacggccgtctgcaggcctgcggctggagcctgcccgccaagtacaagcaggtgcgggcgggcgctgcggggaccgggcggggccccgcagaggcggggcgggggtaaggggcggggcgctgtggggcggggagagggcggggcagtgctagggggtgggagaggacggcgggtggggcggggcctggcaggttcctagtgagcctcctgggcaggggtctggagggtcggagaaggagccccgcggctcccacgcccccacctgcctccagtcttgaagtggctgtgccgccagaagctggcagccctacctgtctcagatttctggagggatgggtaggagccagggttcgtgcccacggcgcctccctgctccctgcagctgagtcccaacgggggccaggaggacacgcggatgaagaacgtgccggtgccggtgtactgccgccctctggtggagaaggaccccaccatgaaggtgagcccgcgaggaccccgctcaggctggctgggcgagcggga

SEQ ID NO: 9858 - DNA, 1232 bp, Homo sapiens
gggcgcaggcggcctgacccttccgcaggcctccgaggagctgctgcgtgagcactacgccgagctgcgtgaacgcccgttctacggccgccttgtcaagtatatggcctccgggccggtggtggccatggtgagtatccgggaagcgggcgggcggctccgggacccccacccccgcgtgataccgcgcccgttcctccgcacaggtatggcaggggctggacgtggtgcgcacctcgcgggcgctcatcggagccacgaacccggccgacgccccgcccggcaccatccgcggggatttctgcatcgaggttggcaagtaaggcccgccccggggacggtcccagccccgtccggcctccccctgttcagcctgcgtggtacccgtgccggaggtctctttcccacgctcacacgcgcctcttccgcgcaggaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgatttgggcccaggaacaggcagctacgacgttaagacatttattacatacagagcagatatgtgggtttgcttgcagggccaaagcctgaggagaatcgtcacccctcccccagccgccccactgctcagcccggagtcacttcgagatcctgggggaacagacgagggagcggacatacatcacagtggaggtggcagggtggtggggagaagccggcagcgcagcggctgcagccctcggtggccagcggggcttgtggggcagctccccaagatctgtgcttctctggttgggggtgggtgcgggggctgggctgccctcataagggcctcccagacaggagtgcagtgggcctggaaggtaggaatagg

SEQ ID NO: 9859 - DNA, 1235 bp, Homo sapiens
gcgtttctcttgcaggagaagtacagcatcggggagcccacagtgccatccaccctggcagaggagtttacctacaaccccttcatgagagtgaggtgaggcccagggcaggtggtgggcgcgggcccctcccctctggcagtcccactgctgcacacacagccggtacgtccgagaccccagatggctgaggctgccttggggagctgtcacaggtgcagccgcagagcccgagcactcttcttgaggggggtccggcctttcctggcaccttggccggggtgtgagtccttctggaccctggagttcagaacctgtcagaaggggagtggctgccgcctccccgccctccgtgtcctctgagggctgggctcggccagcacgagtcgccttcctctgcagtggccctggctcctccggtgggcgtggctcggcacagcctgcagcccggtgctggcctccgcagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataacttccccttgcagactgttttcttctggcctttaggcctctgcttgtcccctcgggcctccttcctcctccgtgagccactgcagtccccccacccacgcttcaggtcaggcgtgagccggtgcctttgctgtggccttggctgggtgctgatgggactgtcaggcccactgctgcggtcggtacctttgcagcctgtgcttgtggtctgatctgctcaggcccccggcagggagaggtggccgcgtcttcttcctggaggcggccagatcgcgcgacctccaggcagtgctcctactcggcagcacccacctgcctctgcttgagaaagcacaaaccgccctctggggaagcagccagctggggagtgctctcggcctgtgaccccgggagggctgggtaggtggccacatgtcctgccccggctctgggtgtggctggtggcagagggtctatgagggaagggcaggacaaaggcaacccctaaggc

SEQ ID NO: 9860 - DNA, 1136 bp, Homo sapiens
agacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttctaagtggcttacaagggtaatttttttccccccagtaatgacgaggagggatatttcctccttgtggggcttcagaccttagtctttgacctttggccttctgagcactgtgctgtgttaacacagttaatcagcaactgtacttcccaaccggagataaggaggctttgtggaagttgaatagcctgggactgctgcttttgctcttgcctgcaccctcctctgaaaaaacatccaggcaagatgcacagcatagctgtcaatgcctggaggagtcctttgggcttcggcaggggttcctgttcgcgttcacatcatctgctggcccctgaagaaagcctaggacatctgattgagtagtaacggtccccatgtattgaacacagtactgttaggcaccatgccaagcagtttattctgtatttccacgtgttatgtaaccagcaaccaagccataagcttagtatgatcactaccatccccattactcagatgaagacagatctagaggctgcgaaggctggctaaagtcactcagcttagtggcagagccgagatgtaacccagctcccccaagaccagaacgtgaagttttgaccacaatgcaggctgcatcttgtaagtagatacataagaagaatcagacacttaggtatgctgcaaccccatgcttaaattataatatagtatgaggaagtgccataattgg

SEQ ID NO: 9861 - DNA, 1166 bp, Homo sapiens
aaaagcgacaagaaggaactagtcagtgtggcctacgcatctggcagccccccgcgagacccagacaagggctcccgcccaggagcgcggactcgggagcctagacccgacccgatgtccgcggattcccgccgcccacgcagaggcccgctgcagcgaccaacaggactcacgtgttttgtcggaaaagaagaacgagacctactgggaagcagcttttatagcacgccaagcgccgcgagatctccgcagccccgccccaagcgggagcgggccgagctcctataagacaacctgtgattggctccgcggtgccccgccctcaccgggctctgagtgctcttgcccgtccggccccagccgcggcccgggaatctacgtcacccgaaaagcgactataaacgccggcgcctccgtccccagccgcggctcgggaatccacccgaagagtggctataaacgtccgcgcctccattgcgctctcctcttcacttaggtaggtcctgccgcgttgaccactggcgtctcgctggtggtcttcgagaccggcgttggttgaaaatcgcccccggctttggccgtggccgcgggtgagattcggcgcccagagcccccgggggcctcagctcaccgcgcgctgccccatgtgcggcggtgaaacccaggccccgacaggcgctgccgcctcccccccgggtgcggtcgctcgcgaggtctggcccctgactcctgaccccgactgcagacccctaaccttgttctttctccgcaggacactggtcctcccacgcctgacaccgacgtcgccaggaccgcggggttgggggaacttggctgtcccacgtctttcaaataaagctgttttgtctaactcactgcatgcgggtgttcttggggccccgactcgcctatcagcctggcggcaagtgcatatgttcacgctgtggcggggagaaccctagcgagatgcctcctcttctttcctggctttggacacaagggtaggatatgggaggttggcaggtgatgtgtaaggtccgacgcctcttaagtggaggagccagactacgaacagtcttgtggccatgcgcatctcaagtgaactacactggcaggtaaaatgccttggtccaaagggctccaggtggagccagcagagcactagc

SEQ ID NO: 9862 - DNA, 1166 bp, Homo sapiens; identical to SEQ ID NO: 9861

SEQ ID NO: 9863 - DNA, 1191 bp, Homo sapiens
cagggccagggagccggtcccctctcccgtgggttgggggaagatgctgcagcccgtggacctcctacccctttactccctcacccaagtgcccttcccagaggagcggactcctcctgtctgtcctcccggctctagcaaagtctgcgcccagcacccgagccccaccctgcccccggggacctggctggtgggttcctgaggatggtctccatctcgggaccggggcaggcaggtgagggtgggggatgggaggtgggcgcggcggagggagaggagggacccggccccgcgcgcatggacccagtggggggcgcgggcgcggccccgccccgtcccgcgcgtccccgccgcggccggcgcgcgctcccgggaggcggcagcggctgcagcgttggtagcatcagcatcagcatcagcggcagcggcagcggcctcgggcggggccggccggacggacaggcggacagaaggcgccaggggcgcgcgtcccgcccgggccggccatggagggcgcctccttcggcgcgggccgcgcaggggccgccctggaccccgtgagctttgcgcggcggccccagaccctgctccgggtcgcgtcctgggtgagtggtccctgcccgggcccccgctcccgcccctgcctcgcgaccttcaggcccctaccagccccctgccccctaccccctgccccctgcttctcgccccccgacctcactcactctcatcctcgccggcccctcccccgccggcctcaggttggggtgacgtcaccgggcagggcgcgcccacctgcgggcggaggaggggccggcggcgccggagagggaccttgagaggtcaccgccggtcgcctctacccctacctcctccccgggtctaatttcagtccctttccgcagcccttactccgtttttcctgttctcgtgacctggaagcagggacggggtggggacggaattctccgaggggcaggagggggctacgggaaccgagaagcgcctccccttcccccgcacacacaccctcgggtctccttggcagggagcctgtcccctggcccccagttccagctgtgagttgagggaggagaggctctgggctgggagggcttcctggcggcggtgtggaaggcaggtttgggagcagcctagcccactggggcgtccctgggagggccctgctgctcc

SEQ ID NO: 9864 - DNA, 2025 bp, Homo sapiens
gtggccctgctcccggcggtgacactgaatgtcctggggccgtgggcggctctcggtgtcttcctaggcagctgctgcagcacgagtgcccgcggtgccccgagctgccacctttcagcctcttcggggacctggagcagcacatgcggaggcagcatgagctcttctgctgccgtctgtgcctccagcacctccaggtgtgcccccccagcgaccccggagagagcctaggcggtgggtggtgcaagggatgtggccacacggctgggaggggcttgtccacctgctgcttctggccccggatggccccctgagggtcaggctgcacgtggcagggaggcctctggctgctggcggggccctctcccgccccttgctgctccgccactggcctgtgggaagaggcaggaggcttggggtcccccagcctgtgcccagcctcctgtgccttgtagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacaggtgggccgggcagcagacagacagatgaccctccctccccgagggcgtggggctaaccgggctgcagccctcctaccgacaccccatctcctgccagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggtgagcaggcacctggcctggatgcccccaggtggggccgcatgaccatgccctgctctggagcctgagatgagaccgagctgtgggtgcaggagctgacctcccaccctccggccaggctggagcgcccgagcaccccttgtgtgccaggagctcttgctccctcagggtctcgggtctgctgccctgggtgcccggggcccttccctggaccaggaggcttttactgagcatctgctgtatgcagatcccacctggggctcggggaccctcctcctctcccttcccactgctcctgtggcttggcacccaggtcgtagaggcccgtggctggcgtggaccctgcgaggctcctgtgccactcccgggctcatgtgcactgtgggtaggaaagcctctgccatccaggcctgagcattggccgggtgtggccttgacggcaggcctgttcctcctattgtcgtcccggggtcccgggaagtgacgggctgtctgctggccgcaggggtcgttggtggcgaagactacgaggaggtggacaggtacagccgccagggccgagtggcccgggctggcactcgcggagcccagcagagccgccgaggaagctggaggtacaaaaggtgggggaccttgcgtgccgctgacattctcctgtggtgaccgtggccagtggccaagctgggagtggggatggggtcagggattgtggccagagttcctggggtcctgagtggcagtagggtctgttgagggtccttggtgggcacaagtttctctctcttttctccagttctagccacagccacagatcccagggttggggtgggtgaaaggggcctgtgtcaattgggcggtcaccgcagctgtacgaggaagcaccgccccggcagccctgcagggcagaggcatcagaccccagatgatcgccccacacactgggcccaggcactgcccgcctgaggcattggtctcgggccatgctcagcctgaaggctggcctccttgtcccagggaagaagaggaccgagaagtagcagctg

SEQ ID NO: 9865 - DNA, 1597 bp, Homo sapiens
aggaggggccaccgtctggggtgtgggactagggctcactccagacaccccacccaccgtgctcaccccaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttcccctcccccttgggacgcgctctaaataattgcaataaaacaaacctttctctgcaaaccatttcctccccgccccctcccctcagcagcggccgtcctgagtgggagtccctgggacttcccagtggccaagttggggcgcccagcctcttcgtggggaccttgggtaaggccagggaggcctgatgtggccgtaggagctgcccctgcccacctgccctggtgtgggggtccctaggccacaccctgctccccacccagctaccctgtgcgcctgtgccctgctgggggcctgggctctccgaggggcctgaggatggaggccccacgtccccgaggagggcggcctctggacaggcccctcattccgcgcggcagctcccaggcctggggaacgtaggtgtgtgagagcggcacccgggaaggacgcctggcctctggctcagccctgcttggcgggctcccccgtggacaccctgttgactttgcacttccctcccgggccccgcacccccgaaccgaccaccgatcgaccggcaccgctgttgcctcgtaagccatagcgcatgcgcgctctcaggataaacaggccctgcctgggacccacacgcctctgtcttttctgagcctcctccccgtggggtgagaggggtggagggatgaggctgtttcagggagccccctccccgagtctcagcagctggaaacggtctcgttcctgagcccgtgccctgcatccatctgctcccagccctgctccatctcccccgctgacccccatgggaccccctgctgtgtggcacatcctgggcccatgcccatctctcttatttggcagactcagcctcccaccttcaccttccctgtgaagccatccggccccacacaacacccacacgggccaccctttgcccaattcaccctgcg

SEQ ID NO: 9866 - DNA, 1273 bp, Homo sapiens
gcaccaccacacttcagcctgggtgaaagagtgatactgcatctcaaaaaaaaaaatttgttttaaagggtagtgtgatgattcacgaagcaatcataatagtagtggccaatggctgttcagtagtgatgggccagatacgatcgtgttgggtttttttttgagaccaagtcttgctcttgttgcccaggctggagtgcagtggtgaaatcttagctcactgcaaccttcgcctccgaggttcaaattattctcctgcctcggcctcccgagtagctgggattacaggcatgcaccaccgcacccagctaatgtttgtatttttagtagagacggggtttcaccacgttgatcaggctggtctcaaactcctgacttcaggtgatccgcctgccttggcctcccgaagtgctgggatgacgggtgcgagccaccacgcccggccacatacgattctaagcactgagataattcatttaagcttcacattactccagtgagtcaggtactattattgtcctggtgttgtagatgaccaaacatacccaaaccagacctccccaccccacagggggaggctgatgcctcaagtgtggcccagggcaacaaaccagggtgtgtcgagggcggggggcggagcctggccagggaatcacccaggacccgccgccaccccggtccctgtcactgcacaagcaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggagggtgagccctgcctgtggcaacgggggccgggtggcagtggcctgagagagacctcagaaggctgaggggggtggcgacggtgcaggaagtgagggtcaagcatctcaggctcggggggtccccctgaagccccccccaggccgtggggccctgaggcctgacgcccagtcccagcagctccttggccttcctgttcgcatcctcccttccttcctctgcttccccgcctcgccgcctgcccacccttcctcaccgccaaggctgcctgcccacccgcctttccctttgtttactgctagcctctcccggtgtgtcaccccctcctgtccagagcccctcaccctccaggagccctggggaggctgctccccaaccccgccgagcactggatggtggtgggcgg

SEQ ID NO: 9867 - DNA, 2401 bp, Homo sapiens
ggatacctgtctcctcctggaagcccgttgcaggccaaggggtcccatggccctcagtccatccacctcctcacctcaggccggcctctgctgggtgggacttggccaggggttggggtggtagaggtgctcggtgaggcttaaagccattttctagcacattctgtatcatgagcaaaatattgcctaggggctatgaaatttgtatcagaatgaactcccataagcctcttccctgtcactgggtgtggagctcaggcagccgctcgcctgcctgagggtgacggtggaaggccacatggggatcccagacctctgtgtgcttgccggaggcagcctgcgggcagaatgcaatctgggcctgtctgtgtggcctccgcctctctgcatgactacaccgtttcgccaggaggccgtaacctagtgctcccgtgggcttcggtgagggggatgtcggtctctagcctcctgagtctgctccgaccagtaggcctggtcttccccacccagcgtctccccgttctctgggacaatgtggtccacgtgattctcaagctgaggctcgctgggccgcccacgccctgttggggtctttccgagcgaggtcctcagccgtgcatgcgttgagctttggcccttggtgataggtggctcggcccgccctacctggcaccctgaccctggtcacggcctctccctccagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtccaggcggcactacagggctgggcgggcctgcgggagctccacgggcaagctgggtttcacgctccctgtcttctaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgaggtgactgcaccttcctttcctccgcgcctgccagcctcgacaccggctgtcccgagcccaggcccacgtggcaccctcgtaccagcctggggactaagtccaccctgtgcgtgggattctcttctcagctccagccccggggtgcatgtgagacagaccaaggaggcgccggccaagctggagtcccaggctgggcagcaggtgtcccgtggggcccgggatcgggtccgttccatgtcgggtgagccttggccccagccacctccacacaggcaccggggctccctcagttgctgctggtcccagtgttcaggaaggccccgagcccaggggccggggtggctggcttcaggcccggcccacgtcctgactctggggtgagccttccacagctcaccccagagccgtggagtggtggagtgtggcccgcttgctgcagaggggcctgctctgggtgctggtgtttcctgcgggttttcagctcggctcagtcctggagcccttctctgctccagcgagccgtggtctgactgcaggacaggttctgggtccctccctgtggccctgggttcactgaggccagcactgtggtgggccgtgccccaagggcagagctgccaccgtctctggctgcctgtggcactagcttgccaggctcggggggagcattcagcttgaggctggtggttttgcatcaggtaagtggtggtcaccagtcctctgccctcttcttcagggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacaggtactgggcggggctggcctgagcgccatctttctgccagtcacccacagagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcactgtgttagccaggatggtctcaatctcctgacctcgtgatccgcc

SEQ ID NO: 9868 - DNA, 1150 bp, Homo sapiens
ggggggctccttaggggaggcagggctctgcgtgggtgtgcctgcaccctgggaactggctctgaacttgggggagatgttcttccacatccctcgtgcacagacggtctgcactttgcagccatccacctgggccggccctggctgctgggcagcctgtggtctcaggggatgctgatacctctgctcacgcagtgtggggcacagctggtggcagtgctgctgcgtcaacgggcgggggccgtagcctggtgctcgggctggtctgtggccctgggatggaggacagatagggcctcaccacctccaggtcaaccccaggtgggctcgagggtgcctgctgacaggggttctctttgggatggtcctttctagtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccaggtgggcctcttgcttccgggcggggctcctgacacctctcctgcgggaacctggtgcctcacttgccccaggccgagcgggctggggtggggtcctcgcctgtgccctagggctggctggaacccctgggagggcggtggagtgggagatggccaggctctgtgttcctccctgtgggctgtggctgccctggccaggccctcacctgggtgcccaccatcccctccctgtgcagtttcgtgttcctgcagctctaccattcccccttctttggcgacgagtcaaac

SEQ ID NO: 9869 - DNA, 1247 bp, Homo sapiens
agggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgcaatctgtgcctctatgtctgtgcactggggtcaggactttatttatttcactgacaggcaataccgtccaaggccagtgcaggagggagggccccggcctcacacaaactcggtgaagtcctccaccgaggagatgaggcgcttccgctggcccacctcatagccaggtgtgggctcggctggagtctgtgcaggggctttgctatgggacggagggtgcaccagaggtaggctggggttggagtaggcggcttcctcgcagatctgaaggcagaggcggcttgggcagtaagtctgggaggcgtggcaaccgctctgcccacacacccgccccacagcttgggcagccagcacaccccgctgagggagccccatattccctacccgctggcggagccgcttgatgtggcggagcc

SEQ ID NO: 9870 - DNA, 1150 bp, Homo sapiens
atccgtcgtgcgggggtccacgggccatgaccgtgaggacgtgatgcagccctgcctccctctccacaggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcgggctacctggtgggctttaaattcctggaaagtcacggctctgacagtggctccgctaactcattccactgtctcatttcacaaaatgaatttaaaactctgctccctgacctcacacgagcccccgtgagtctctcacgccctctgctgtgttctcgcctggctaaagcgag

SEQ ID NO: 9871 - DNA, 1271 bp, Homo sapiens
ccgcacttccgaaactacgacttccggcggcctcgtcgtcgcggggcgggaatggcagcttcagaatcactctatgttgcagatcgaagtctgattggctttgttcatccgtcactcaccgttaggcttcacggactctgcataagggaggagcttcgggtctgggtctgagagaccgtctccaaaagaaatgccacggtacgattggtggaaacaacgcggcagggagcggagcgtaccagcggcgggggaaggcgggcacttccgccaggatagcccaatgacagaggtgggacagtttctataaaagcttgagcctcgcccgcccctgtcttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtaagactgggccgggcttgggttcccttattctcccagtctgtgatgaattgctttgacttctgacacctcgtatgaaaactgcacgtgcagtctgattatttagcaagactgaggcttgagggtgcgcactcctgacggggagctgagagtggaaacaggtgttgcccgaaacgaaggagtggggacttaatgtctgtattttggcgctgactttcaggtttcgtcgcgagccggctgcaagttttgaacctaagtaaacctcaatccggagggcctagcggtaaggtgggcgctgtgtctattgaagtgcttagcaataaagaaaggtagtgagttgattcggttttctctcaagtgtctttattttcctattctggcaccccagaggtctggctgatccacaggcaatcttggaaaagggtacagacatgaaaacggaagctcgttaccagtgacttttcatctcttgggattgccttctccatttctgcccgtgattttttttttttttttttgagacggagttttgctcgtttcccaggcgggagtgcgatggcacaacctccacctcaagcgattttcctgcctgagcctcccaaatggctggaattacaggcgcccaccaccacgcccggctaattttgtatttttagtagagacggggtttctccgtgttaggctggtctcaaactcctgacctcaggtgatctgcccacctca

SEQ ID NO: 9872 - DNA, 1177 bp, Homo sapiens
agttgggctccggtgactcaccctgcaggttctttctctggggtgtggctggtgtctccccgctgcagcctggtgctggctgggtcctgaccgcacctgtcgtggcaggaaacacattcgtcgtgccttggctggtccctgtgtgactgcgtcccgccacgtgggccacaccctgggcctacccaccaaggcccagccttggccccagggacattcagcctggaggtgactggctgtgactcaggacccagaggagtagagggagccaggcaggggtccctccacctcggggaagagctggatgggctcttcgggagctcagaaaggctaagccttgagggacggtgacgcagagccgcctgcctgcccgggcctctgcatacctgggatcggggtgaaggacctttgcctcctagaggcctgcctgagccggggctggtggtggaaggctgctgcggcggccccacggtgccccacagcaggtctgcacacttgcagcagcccgtctgactcacaggggcctgggctccatctctcaagcccctcatttgtgctccacccacaggaggtgcttcccaaggaccgtagatgcctctctagagcatgagctcaggcaagagtgcccgctacaaccgcttctccggggggcccagcaatcttcccaccccagacgtcaccacaggggtaagggtgtgcccctctgcaagcccaacatccccaggacccccagcatgccccagggatctggtgttgcctgcagagctcccagcgcagtcccgtcccgagctggggtctcaggggagctcggtgggggggggtgtggtgtgtgtgtgtgtgtgtgtgcgcgcgcgcgcgcgcgcgcgcacgcgtgcgtgtgtggttggggcgtgttagtgctgtgtggcgcggcctggttgcatggttaagcgtgtgagtgctgcgtggcgcggcctggtcgcatggttaagcgtgtgagtgctgcgtgacctggcctggtcgcatggtaaagcgtgttagtgctgcgtggcgcggcctggttgcatggttaagcgtgttagtgctgcgtggtgcggcctggtcgcatggttaagcgtgtgagtgctgcgtggcctggcctggtcgcatggttaagcgtgttagtgctgcgtggcctggcctggtcgcatggttaagcgtg

SEQ ID NO: 9873 - DNA, 1099 bp, Homo sapiens
tggctgtgccagggacaccaggatgcggtcctggcccttctgtatcccagcccacacctcaacctcagcttccccctctgtgagtggaggctgtcagggaactcacctggcagaggtgcctcaagaggcaaataaaatggcacccccagctgctgccaggcggccttcagagtgatggctgcgtgctggccatgagcctcagctggctcaattggggtgctggggagcttgtagaggccctgaaagaagaccctgcctggggtaggcagggctggggcaggggctaccgggctcagcgctgggactgtccagatgtagaccgagcccagcgtccatgctcctggcactggtttgaccttgagagggaacccaagcttcccccgtgccatccctgcatgctttcctgcctgcctggccctggggagggctgtgagctacaggggacccacagggtcgggtatccagcatgggccccacctcccccacatctgctgagggagcccccactgagacgccagccctcttgccttgcagctgacgggaccagcacctacaagcagcactgcaggacaccctcctcctccagcacccttgcctactccccgcgggacgaggaggacagcatggtaggtccctacccccaggagcccgtgtgagcctcagcctccccccatcctccctcctgggggaaccaggtcccaggaggagttgacagtgagctggtgaggcacaggagaagaagagcacctgtggataccctgaggcctcggcagacatggcaagtctgtgagaaaggaggctcctgtggctggactgtgggtggcagggggcagccagtgagggcagctgggtcagagggcctggcacctgcaggccaggatgaggcatatttggctccatcttaagggaggtggaaaccacagaaagttcagtcaggaggatagcacaataaaatacatgctttgaaagcttcctttgctgctgggtagggaatgagcggggttgctgggtccaggcagggtttgaggaggggtcctgatgaggcggggggaaaggtgtgtggacctaagctgtggggacaccagaggcaatggggtgg

SEQ ID NO: 9874 - DNA, 1102 bp, Homo sapiens
tgggcctggtgtcccccaccagcaaggccagacaagcagccaggcccggggggcacctggagcccagccgtcgctccctgccagcattcctggcccttccatcctgcggtcacggcctcggctgtccaggattggctggtggaggtgccccctcacggcccacattcccccacgggaagcaggaagcagcccgggtatatggaattgaatagcaggaagtctctccatttacacaaagagaggtggcaggcgtgagcgggcagcccagcaccccggcccaggccgcccaggcgggcaggcagggacctgggttgcatcagctccccacgcccacccacggcccccgtggacgaggagagtacccgcagggaccggggtggccccaggggtgctgctgccctcgcgcttccgccgggctgggtcctgtcctccccgaggctctgaccccgtgcggagccccccgacaggcgcctctccctccacacagccccccatcagcactccccgccgctccgactccgccatctctgtccgctccctgcactcagagtccagcatgtctctgcgctccacattctcactgcccgaggaggaggaggagccggtaggtgtgggggactcggcgcagagcggcttccagggctgtcaccgcagccgtggcacggaggcaccttcccctccgccatgcccgcccagctcacagggagagggcggctggggcctgacgggaactgcagtgcttgctggtccgtggtggggactcgagggaccaggccgggtcccctgggcatgttcccccactcccccttctcagggctgcccgggaactggcagcgggaagcacagggctccagcagggccctttctagtctcaccccaggaaggaggcgggcgagggcggccaaggctgggcggctgaactcatcctccggggttgggccctgcctctggggccacagacctcgctctccctcctgggccccgatcaagccccccagctctaagcaggcctctctcaggacgtgaccctgtcctcagaggacagccaggcctggagcaagagcgcctgggtgcctgggtggtggcggggctgagggtggcc

SEQ ID NO: 9875 - DNA, 1231 bp, Homo sapiens
agccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaagcagatgtcgatgcagagataaatcagccgctgtctccggggccctgtggcgagggtgccgtgaatctccaagggctccgcccccagctcctcaaaccatcccgagggcctggccttcccccacagcggtcctgactcaccctctgctcgccgggcccagtagatgggggtcctcatgcacaggcgctgcaccaaagcccccgcctgggcggggtccacttcgaggctcccctgcactgccagcagctcctgggtgtggtgggtgtcctggctggggacccaagcctcttggacctgttgagaaggctctggtgggcggtgggacagggctgctccctgctcctggcttggcagggccgggtaccctccaacccccagtgatgtccccaccctcagctcttgtcagcagcctgggcttagggcggagagagcttcctgttccctgaaaccacagctccagcctgtcccgtactgggctgcacacaggaccctttgtctagcccctggcccgggcctgcgcccagcaggacggctcaccttggaggtatccaccagcagccgcagggtctcccgatcactgtcctccatcaggcggaggaagcagacctggtgctcctcagggcggtaacagatgcagccctggggaggcaggggggtgaggcggggccccccagaccgacacctgccagggtgacccctccctgcccactcacgctctgcccgtcgaacagcaccgcccagctgtggttgctctgaggtggggtcactgtgatggtcgccgcgttccgggccacgtccaccaggatggtttggttgggccggggcatgtgggggctcgggagggtcattcgcagcgtctgcagccttggctggcagtgggagttggagttcagccggg

SEQ ID NO: 9876 - DNA, 1185 bp, Homo sapiens
attgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccttacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagt

SEQ ID NO: 9877 - DNA, 1248 bp, Homo sapiens
cagagtgagaccccatctcaaaataaatatatacacacacaaaaattagctgggcgtggtggcgcgcgcctgtagtcccagttgcatgggaggctgaggcaggagaatcgcttgaaccctggaggcagaggttgcagtgagctgagatcgtgccactgcactctggcctggagacagagtgatattccatctcaaaaagtaaaactatggggaattgcccagaaagaagctagcttgcccctacagcctgagctactctgatgtggtttctcctcttcccgcaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatctagttctgggttcactgc

SEQ ID NO: 9878 - DNA, 3314 bp, Homo sapiens
ccaagctcctttctgttccctcattttatgaaagatattactggtctccagaacagagtctaataagatagttaaggaaagtagtaggtatttaggacttaaatatgatctggcggaaagaaagaaagtgaggtttttgcttgcctgatggcattaaaattaggaagccatcaagtccatctagcattgtggttggcggccctccagggatcctgaacactcggtggcacttcacaatggaattaggaatggccaagaaccaccccccaaaaggggcccctgtgtggctccctgctcctgctaggacagggaccactcagtgtgacattccggggcctgttggagatactcagaggcgggggagtggtgagttctcggctgtgacagccccccaagcgctctcccactccaccctgttgtttgcccctctgtctggatctctcggaacagctggttttctctttgtttccacaggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctggtgagaagctcggttagggttcgtgttaccagcccgggctgttgactagtgacagtcatatgggggcagccccactttgcaaaagtatttcttgaagaaatacttttcaggacatttggcttggttccaagtctttgctgttgtgaatagtgccgcaataaacatacgtgtgcatgtgtccttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctcctcatcctctccagcacctgttgtttcctgacttttgaatgattgccattctaactggtatgagatggtatctcactgtggttttgatttgcatttctctgatggccagtgatgatgagcattttttcatgtgtcttttggctgcataaatgtcttcttttgagaagtgtttgttcatatcctttgcccactttttgatggggttgtttggttttttcttgtaaatttatttgagttcattgtagattctggatattagccctttgtcagatgagtagattgcaaaaattttctcccattctgtaggttccctgttcactctgatggtagtttcctttgttgtgcagaagctcttgagtttaattagatcccatttgtcaattttggcttttgttgccattgcttttcgtgttttagtcatgaagtccttgcccatgcctatgtcctgaatggtaatgcctaggttttcttctagggtttttatggtttcaggcctaacattgaagtctttaatccatctcgaattaatttttgtataaggtgtatggaagggatctggtttcagctttctacatatggctagccagttttcccagcacaggaaggggaacatcacacactggggcctgttgtggggtgggggggcggggggagggatagcattaggagatatacctaatgttaaatgacgagtaaatgggtgcagcacaccagcatggcacatgtatacctatgtaactaacctgcacattgtgcacacgtaccctaaaacttaaagtataattaaaaaaaaaaagaaagaaatacttttcaggaacatttactcttgtttataggaaaagtaaaacatccagtataactggtttctgaaagactaaaataatccttgaagatagcaaaggccctttctctatatcctggaagacgtgctcttgaatgaaacatttgtatttcagctttttttcttttttttttttttcagacagaatcttgctctgtcgccaagctggagtgcagtggcgcgacctcggctcactgcaaccgctgtgtcccaggttcaagcgattctcctgcctcaacctcccaagtagctgggattacaggcgcacaccaccacgcccagctaatttttgtatttttagtagagacggggtttcaccacgttggccaggatggtctcgatctcttgacctcatgattcacccacctcggcttcccaaagttctgggattacaggcatgagccaccacacccggctgtacgtcagcttttaaaagctcccgtttgagttcatggggcttggtttacattttctttttctgccgggccttctctgtgtacagacttactggcatttttagctccgtggtccttgtgcacctgatccatggtttgacggaatcagtgtggtgttcatggaagccagatcttggttactctgatgccccatcagtgtgtgtcttcgtgtggacctgggcaggtggttggtacgtgtgcctcctctgaagcatggtcttgtcttggaactgagctagggacagccaagaagtgactcggacccaggactaggcttagctgtcaggccaagaaagaccccactgcaggttctgggtggaagtccagggtgttctggagaacgtcgtatttcacgggtctggcaggagacagaactcatggaagtttgccatggaagtcacagcaacgtcccatccctccatgaggcatgattctgagacacaagtgccaggcaggcaggagacagcatgcatgcagccagcgcttagcgatgtcccttactggtgccagggctgtcaccaggctaatgctctagggcaagattttacatctagaactaagatgaacaagacctggtgtggggtgtgtgaggccccagagcgatgcccttgacaggtcacccagcctggagctcaggagaagctatgtccagctgtcacacatgatgcttgctgcctgcagcaggggactgcaggaggggacactggctgctgagactggggcccaggcaggagctgctcagctccctcctgtttttggggaacaattccctaagcttggaagcaagagaaaaccaatctcaaaggaaaagactgacagatttcagcatgtacaaactggaaatttgccagacacgaaaagacctaatggtggtttaaaaaaaaaaaaaaaaaagcacatagcagactggggaaaacctttgtggcaaatgacacagagtaaatatcttttgttagagaaaaaaagttttgttattaagaatagtcggttagtcctcagcaagacagagaacctgagggggaagaaaagtt

SEQ ID NO: 9879 - DNA, 1153 bp, Homo sapiens
agctctttaacccggggcggatgtcgcgtcccgcgcagggagccccggcggccgggcgcgcggtttaaatgcccggcgggcgcccgagcccctcggagccttcccccgcggcgacgttttccggccctttcctggggcaacgatcgggtcccggggcagcgatccggcgatcgggtcccggggcggcgatcgggtctcggggagccaaacaccagcgcctcctggtcggggaaagggctgcggagcgcgtgggggcgaagcgatcccgcagcccggccgggccctgaccgagcctcagtccagcggggccgtggacctagctctgtggaaagcagcgttcggccccgcgcgcgttgaggcacaggaaacacgaactgtggtttcagctattatcatagtatctgtcctggagccggagaatgaggaatattttatggagaggtctatagaatctttgagaattcgtcgccctggaatacgtttggcttttgcagctgatttaattgctaacaggaagaccccggtcaagagaggggagccgggagcaatcgctaggaagtcctagcaaggcggggagggatttgggcccacagaggggagtggcgcttcctttcaggactggaaggaaggatggatagaaaggtagatttgtagatggggaggcaggatcctgaggttcctgtctgagggcttctgtttccctgtgaaataagggctaaggtcatctgcttagagtgaggaaggggttgctggagtaggagttggaaaatccggctgtgggaagaggagagagcacatctgagaagcatgtccgggctgcctgcctggtgggtggaatgcccgtctcacctttaatgattgcatctgtacacaaacctacaggtctaggtttgtgttgggacctgagcaacaaccttactgcgtagctgtcaactccgcattctacaatagagggcacactgagactctgcagagctgagacttggacgcacactgccccggcctccaagtctgtggcttctctccagggccgacccttctaatttggacttgaaaaccagactcttcaagcccacagatctttattgaacattatgcaccttggtcacgtgtgcaaaaagcaaagctatccagcaaaggccccaggagtttt

SEQ ID NO: 9880 - DNA, 1116 bp, Homo sapiens
atttctctgtttttgggtggctagctggtaacttctgaaaatagctgtttttaataatcacagtgtttgctgggatgaagctgtgatgaggcaggtgctcctattcctgggtgtaaacattggcagaagcctttcggagagcactggggcgtatggccagagacttaacacagcttccccaggcattagccatgtaagaaactgagacctgagccacggtggaaaggccactgacatttcattatatatcttttctcatgtcatctattacttatacaaaaaggaataataattaaaacctgagccatccttgttcccgaagcttgtgaaggtttaagttaagtagggcagtgtgtccacatgcatttggtgcctgaatgggcctttgcttcagaaatggaaaactgcaacatggctgctgtctcacgctcatgtttgtcttttcttcctcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtgaggcattcaggccggggcttctaatcagagcggcgcggaagccagcctccaggggaagggagccctttccacttaaccccagttacctgtgacagggcggcatagagttcccttatcaccctttttttttttttgaagtggagtctcgctctgtcgcccaggctggagtgcagtggcgcgatctcagctcactgcaagctccgcctcctgggttcgagcaattctcctgcctcagcctcccgagtagctgggactacaggcacccaccaccatgcccggctaattttttgtatttttagtagagatggggtttcaccatgttagccaggatggtctcaatctcctgacctcgtgatccgcccgctttggcctcccaaagtgctgggattacaggcgtgagccaccgcgcccagccttgggtgttttttaaaaccagtaatgccaaagttatcgtggactttttggaagaaaatatcctactctgctttcttcagttactttttttttt

SEQ ID NO: 9881 - DNA, 1100 bp, Homo sapiens
ttattatgatgattattttttgagacagtgtcttgctctgtcacccaggttggaatgcagtggtgtaatcaaagctcactgcagcctcaacttcctgggcttaagcaatcctcccaccttagcgtcccaagtaactgagactataggcacgtgccaccatgctctgctaattttttattttttaactttttgaagagatagggtcttgctttgttgcccagggtggtctcgaactcctggctgagctgtcctcctgcctgggcctccccttttttaaatgccccttgtcagccacaggcagctggctccattatgaagcctctgtttgtcaccaaagcccaacgccatggctccctccctaccttgaggcctcctaaagccttgggtccctccgccccacccctgccccaggaagtgggctccaccctgagaccccttctcggcgttgcaggtttatcagtaaagagatcctgaccatccgggaggccgtatggctcacggacaacacttacaagtacgaggacctggtgagaatgatgggcgagatcgtctccgccttggaagggaagattcgagtaagcagcggttccattttccttattaatcttcgttgtcgctgtgctggagggtgggggtgggcattcagctttcctgctgtgggagggcctcatggactcagagagcagctgtctctgctgtgcccaaagccatggagcaggaggccacggttgcaccacgtcgccatctgcgctggtgcgctacgcgtgcagcatcggcgtgaacatcatccgggccagaccctgcgctgggcctgcatgcggcactgcaccaaggagcccccgagcgctgagagcccacaccccgtcccggctgtctaggtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagagtaaggagtggcccttcccagggatgcctgtgtcggggaag

SEQ ID NO: 9882 - DNA, 1293 bp, Homo sapiens
atgacttccctccccaccaaccttcctgcagtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattc

SEQ ID NO: 9883 - DNA, 1523 bp, Homo sapiens
ttctcttgcgggcctccttctgcctgggcctgtctgccattcgtgagtgagccctggccttcccgtcgtgtgcaagtaaggggtcatttgtggtggaagaagtggtctagacttctccttccccctaggcaccgcctgctctttccacagactcaaggcttctcccaacaggctgccgagcccttccccccagcctcctctgttctttgccctcagaatgccttcagagattccattttgcctggccacctgtggggtattagcttgtggctgtcactcattcatccaaacaatcttgattgagcgcttactatgtgccaggtactggtaggacagcagtgaacaaaatgggatccccgcccatgtggaacttaaattctagctgttgctgcttgcccttgaagccctgagtttgtccaccaagccctttttctgcacccagctcctttcctctctctccgtcaagacctacacaggtctttgggcagcctgaccagcaggtgtctggaaattgagaacacggtattgctggcctaggcctttcctgcttatccctggctcttcgggataaacgtggcttactgtggctctccaggagctgacctctgacttcacttggccaattcagacaactgcttttttttttttttttttttttctcccctcctcaagacagggtcttgctctgtttcccaggctggagtgcagtggtgtggtcatggctcactacagcctcaacctcccaggctcaagcaatcctcctgcctcagcctcctgaataactaggactacaggcacaggctaccatgcccagctaattttttttttttagagacagggtctcgccatgtggctcaggctggtctcaaactccttgttgcctcaaacgatccacctgcttctgcctcgtaaagggctgggattataggcatgagccaccatgactggctcaacttctgacttcatttctgccttctcagcatgctttcctccaggacctggcttcacctgctgtgccgacctaaacaagccccctgccctccagtggcctctgctgttgccacaacgccaacctccagctgtgtccccagctcctggcccttggcctgcctggcactgacggattggtcttaaaccgaatgaggtccacaaacctcttgcaggcccccgtcccagcttccccttttttttctcatgacaaatgtcctgttctttcttcatcatgtccttcaagaagttgtcatttgctccttttctgtatttcctgtgacttcctccctgctggcgagtgccttgtattttatgcttgtgtttctgcaactgctttctggccccccactctttctgtggctgctgagcctagtgccgctcacaggtctgccttctgcagtctggtcaggcttggcctccggactggagtccagggtgctcatggtattccgctcctggtggccatccctttcttccctgtgctcctcttggtgcctcctccccctgccagccacatgattcttcctgctgcc

SEQ ID NO: 9884 - DNA, 1214 bp, Homo sapiens
aggatgtcactactgcaatccatctgtggccgattttttccaagagccaatttccttgttttggttgcaagaacctggctctgcctgcatgtcagctctctgccctccctgctgccgtggctttcaagcgcttggcagaatcttgtacttcgtgtccacaatggtactgaatttgcatctgcacagtcagcagagataacaagtgttgaactgaccttgccacatgcttagtgagtgatttgtaattaagtttatagactcagaaggtatattaggacatttggaatcagtagcagagcaaagcctctttgaaaaaaaccacgtagctgattgggttttacaagagtgcatttgtctcccccttccacccgtggggccccaccttcaggtcttagtggttcacaagagcccagcagccaggctggctttttcattgtagggcgtggttgtcccagctggtgtagatttcaggccgccccccccaactccctgcccacagtgttgcagattgcctggctggcagcaagtccagaccacccaaatttggttggattcttcatttctccactgtagttggggtccattgattgtgcaggggaacgtgcaggaggtttttctaggcaccgtgttcagtgctgcttcactctaccagagattatggccaaattgcacggaatttggtttcttgccctctgaagcctgagggcccccccttgcctggctggttgacagacccggggtggtcactgctgagacttcagagatcgcagctgctgtgagaatacggtgaaggtactttgttctggaagatgttgtcatacacttttccccagttattttcaaacttgacatgagcctatgttgactcactgggtgggggtcccttcttacgcagcacacgtggcaagtgcctgaatcggggctggaggcacttcagagcctctgaggggccaccacttctggcccaaaattgcagggttgtagatgaggctgcctgtggagaactggtgtgaggaggaagctgtttccaacaaagagcactttcatctgttgagatggctgtggtgagcaactgaacgagcctacgtgtgtacctgaattttccccgtaactcatttcttccatatgaagaaacaccaaactatgtacagagaactttttacaaaaggcagaccttttttaagctgtgtaacccacatagcctaaccacctgg

SEQ ID NO: 9885 - DNA, 1844 bp, Homo sapiens
ggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaatgcgcgtagtagctgtttatggtcttaagatgcaggggaatgccaccccgggtcgctcggaccaaggtgctgcccctccaagccgcccagccccactggccgcggcggctcactcagggctctgcctctgcctctcagtcgatggccagggcggagctgggccatccacggggtgccggcttggccagggtcactggatcagagctgcacggcccatccctgcaccccactctgcctggacccctcacctacctccagcagatagcatacccccatcccgggagaccggagaccatgtacaagggcctttttttttccttaagagacaggggtcttgctatg

SEQ ID NO: 9886 - DNA, 1161 bp, Homo sapiens
aagggacagtgtggagagattttagaggaacaagatccttgtttgcctagggtggaaaaagaagaaaatttaggtgtagggagggattatttagaattctgtgcaagggcattgagagaaaggctgtaagaactgggctgtgatttggtagaaaggaaatttggaagggcaaagaagtggttttcttgggagaccaggaggatggtggagcattatacagcgaagacttagtgtgaagatcaatgttgaattagggatgaaggagagcagggacttgggtgtggggcggtaagtggttagtttggggccaggggcctgacccgtgtctccccgctccccctcaggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtgagggagagctgggggagagtcaagcactgaatgagtgcagagctgggggtgttaggtgggatgtatagggagcttagggtggttgaaagaggcctggcaaagagttgtggtaggggaggaggcagatgagctctagagaagtgaaaacagttaagggacagtgcagagtgggaaatgagaaggctgtgtgtctggggcatagatgggagcctgaggtactaaatggaggcacgtgggagaagggaggggccattgaggaacaaaaatgtgttttaaggaagagatgggaaagcagagaccaggtagaggagctaggtaagctgataggtgttgtcattggtagaaaagaagaagataaatggatgtaaggattgaggccttggaaagtagcataggcaggaaaagaggaattagaagaatacgtgaagaagtgggaatcatgggctgggaagggaaattttggaaaaggagcccattaaggcagaaaactcttttagagcagtggttttaaacttcagcaatggtgatccttttatacagt

SEQ ID NO: 9887 - DNA, 1286 bp, Homo sapiens
gtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcg

SEQ ID NO: 9888 - DNA, 2546 bp, Homo sapiens
gagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagaggtgagggagctt

SEQ ID NO: 9889 - DNA, 2630 bp, Homo sapiens
aagccccaagaagccaccccctggcgagcggaggtgagtgctgtcttgcctgagttgaaaggtgggtgggggagtgacttgtccagagaaggggccctggggtgtgagctccccgctgggtgtctcacgtggccttgggcatctggttgtgggggaggaggcacttgctctcctctccccatgctcgttgcaccctgttctggcgaagggctgcgccatccacagcggcgctcaggccaggaccagggggtccttggtttcttcctctccctccctcaacacatagcctgttcccagggttctagctttgtctccctgttgctactgccagggctctggtctggccaccatcatcttctcccgactctgtccacagcctcctccctgtctccccgtctccacgccattctcttccacatgtagccagagggacctttctaaaacgcacatctggctacttccctccactccacaaatccttcgggacgccctgtggcctgcaggacaaagccccacctctgcgggagtggcgtgtgaggctcttcaccaacgggccttgcccgccctgtgttctcctcctgcccgcccccacacatgccctgtgctccagccacacccagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtccccctcccttgggtccccagagccacgcacatccagccctgcttcccacacacggggccgtgcgtgcctttcttcaccactgagctccttcaagggcagggactgtctttatctttgcatcccccgctgcaccctgtgcctgcccactgggcactcggtggatggtgtgcgggcggatgggtgagtgagcggacaaaggtgggtctgaggctggccctgtgtggtgtgaggtttggtggtcaggacctgggcgggtggtcctgagtgctggcccgtgtgcttgaaagggtgtggtgctattgggtcctactgtgttccccaggtcccgcagcccccggaagccaatagactccctcagggactctcggtccctcagctactcgcctgtggagcgtcgccgtccctcgccccagccctcaccacgggaccagcagaggtaaggccaactgcaggtgtcagcacccagcctgtctggccgccactgctttctacaaagaagaaagctttgcggttgtggctatgtggtgcctgaggtggtgccaccctgtggcctgatgtctgtcctgtgttgcagcagcagcagtgagcggggttcccggagaggccagcgtggggacagccgctcccccagccacaagcgcaggagggagacacctagccctcggcccatgagacaccgctcctccaggtgcgtgtcctggaaggctgatgcccccttccgggagccagttgtggtggtgggtggcggccccattttgggagtggcccagaaactggccttgagggctggggtgggaactccctgttgacccatatcttctcttgcaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcaggaactgggtctgtagactgtttattaaaggtgtgttaagggggcagccacttccctccgtgattacagcccccagcgtgggtggacctgtgtgggtccgtcttggggttccctcgttgaacatgctgtcaaaccaggacactggctccagcttgtgtttctgctcttggccatcgtctgggagtggacatgcaggctatgggggtggggggcacttagaaggagaaaggcctaaaactggaatctcttgtccctgaggctggctctggtctttgtgtctctcccagtccttccctttcctccccctggcgtggttggtgtggctggctagctgctaacaatggcttgggtctcagggcaacccaggtccccatggtgcctttaagcagcaggctgggccaagttctcagccagggtctcaggatctgggagacaggacagcacaggaactgccaagcacaagccccaaaagg

SEQ ID NO: 9890 - DNA, 1242 bp, Homo sapiens
ccactgtgttgtgtgtcctctgccataggcaaaggatggacgggtgggcaagtctgcccttggcccaggggtgccacttgcccaggcttatgcagatgagtctaggcgtaacgcaggctaatggcgagaacagagcatcctgcctcttccagcaacacgacgcaaatgtcctgccatatccgggcctgggagaggccacaggctgcagctggccccccagcagcccttccagaggccccaaccccaggtgtctccgtccactcttggtccaggttacgtctgggccaggtgactgtaacagcccaggcatggggaggggtctccccctgggcactggcatggagatgtgacggagtgtggtttcacggcggccaactgttgctgcaagagggatgtgaacaagtaccagctccacacggtgagatggaaaataggatttattgggggaaccgtacaagcagaggagaagcaggggtgcccaggctgtcacagccttgcagtgcatggtgggttccgtggccaacttgccaggggacaggcctgttgctggcactccccccacaattacagggtgggagtgaaggacctcgcggctgcggacaggtccttgttagtaaggaggaggctctgcagtcccggtggggtcatcttgcctctccggactgctccctctgactggtgaagccacactctgtgaagctgtctgacagaaggggacacgcctttgctgcccaggatggacctgggccacccaggatgccgctggcctcagccagggcacgtgtgcccagcgctggctcctgctgacccctggactggctcccatctcgggaatgacgcctgccgtgggaatcgtggagagggggtttaatttaacttggaaggagcacagaaaggaaagtgtggagtgcggagcgaggcctctggtttggccagctccggttgctggggatggccacaccctggcagcaggcggccagagaccaggaaggcctacccagcacctgtccagaagagattggtgtgggttgacctggcctatgcggggcagctcagtttgaagcaggaacttccccaaacgtgcccaggctccaagacagcagcattcactttgcaccgtgctgagcagagcggggcctcgccaggtggaaagccctaggaaggctgcgtgctctgcaaacccaggggtgctgtggccgtacagcaggggcgtccgtgtccaggcagctttgtcatgtcttc

SEQ ID NO: 9891 - DNA, 1181 bp, Homo sapiens
tcagtgcaggtcggccctggctcctccgtcgctgggtctccacagacccagcccgagggatggaggtttgtctggttttgttattaccctgggcaggggtctgagacagatgccagctacaccaccgtgccccgtgtgtgaacccttaatggggtctgccaggttgtccccctatgtgattgtgccacttgtggctcaccctcactgtgtgcgtgggtaccacctcccttccaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcaggtggggaccggggcacgccaggtgtttggcaggctgtgggaggcccttcctgggacggaagctccattccccaggagggaagctccaccctagcccaggacacccggcctcagagccacaaggctgagacgccatccctgccctccagtggagagcgtctctggtcaggctgcctgtgagcctcgaaccctccagagccactttgtgtaacctgcctcctcacagctccacaggagaaacaattgtcactccatttacagccagattaagggccttgccggagcccactgctagcaagtggcatagctgagactggccctaggtgctgggttccagggtccacactggtaaccactgccctgatcatcaggatagtaatacctgccagcagtaactgtggtgcctgtccatcagggcactgggaggactcaccactgtggcttgtgggctccc

SEQ ID NO: 9892 - DNA, 1145 bp, Homo sapiens
gtgattctccggtgtcagcctcccaatgtgctggcattacaggtctgagccaccaggcaaggccctggcacttttagcgctaaaaagggaaaagtctcaggcgggccaggatgggctggtcaccctagatccattgcgcccttgatttccagatgggacccctccccacccagccacacaccctgggggaggagacctcctgctgtctcatgccttcctgcgaacccctttgtcccctgcaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcggtgagtggggccggcggcggggcgcgctggggccggcgcggggagcccacccctgacctcccggcctccaccctgcagggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtggggagcgcggtgacctgcgggttactgggcctgggggtggggagagggatgtggggaatggggacatggaggccaccctgcggggatgggggtccttgggcatcagggagcggcggggcggggagggaccgggactcaagctctgctcctccaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggt

SEQ ID NO: 9893 - DNA, 1189 bp, Homo sapiens
acggccccaccatccgctcaagacacaaaggacagctcaagcccaggctaggcccgaacccccgccctctcaatcaccttgctctggccagaccgaaatttcaggcctacagggcactgttggccgaacccacattttgttaccgattttctttcgagttccggtgtctcccagtcttctttctgtccttcttctcggaaacattacgtccccctggggtcaccctaagactctacttcagcaggcaaacaggcccggagctcacggaggagaccccgccagcggaagcggaaatggttgcttagagaaaaggaggaaaactacctctcgcagctgcccagtggctacaggtcctcggttaaggtgttcaattggtcaacacaaaagaaggacttccccttcgggagaacttcgaccaatcaaagggcaggatggcggagagggctgagggcgggtcgcttccggcggcttttcccgcagctcctgcgtaaaggagcatgagagcgtgggagttttgcagtggccgtggcgttcttcgtcgcgtctcggtcgggcgtcgctttctgcagctcctgtcagggagcgcgaggcctgttattaaccgcggagcggtaagtgggcccctttcgaggccgggccaagaggaggagcagtcggcgtaggtttttaagggggggttcggagggaatcgagggaggctaggggtagtggaggaacttggcagcggaattggtccctttaagaactgttctctccccccgcagctttgtcacgaagtccctgtggcgtcttgaagaaggcattccccacccgccaaatggcgtccatgcccccgacgcccgaggcccaggtgagtcgaggtacctttttcgtccaagtttattgctgctttcggtctctgcctgaccccctcctttggaggagagttgggcatgcctgttgtggtaggagtgctcctgagccccaaatagccctttgaccaagtgttcttcgttccaagaccacacacataatggtttaccaacttccttctttcagaactaccaactgggagcagggacctgtggaggaatctctgagagagtttctcaatgtcttatctgtttgttttgttttgtttggagatagggtctggccttgtcgctggagtgttgcttgtctggctggagtgcagtgctgatatcatagc

SEQ ID NO: 9894 - DNA, 1395 bp, Homo sapiens
gcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggg

SEQ ID NO: 9895 - DNA, 1226 bp, Homo sapiens
ctgcaacctccacctcctgggtccaagcgattctcccgcctcagcctcccgagtagctgggattacaagcgcccatcgccatgccatgcccggctaatttttttgtatttttagtacagatggggtttcaccatgttggccaagctggtctcgaactcctaacctcaagtgatccacccactttggtctcccacagtgctgggattacaagcctgagccactgtgcctggcctgtttttgagtcaggggtcttgctctgtcacccaggctgaagtgcagtggcgcaattacagctcattgtagcctcgacctcccaggctcaagtgatcctcccacctcaacctcctgagtagctgggactacaggcagctgccaccatgcccagctaattttttttttttagtagagactgggtcttgctatgttgccctggctttgggcatacattcctttgtatgtctaataccccactgatggtatgccacattttgcttatccattcatctactagtggacacacgggttgtttttaatttgtggttattaataatgccacttaggaatattgatgtgcaagttttcgtgtagacatgttttccttcttcttggttctgtacttaggagtggaattgctgggtcatatggcaactgtgtttagcattgtgaggaactgcgagactgttttccaaagtgactgcaccattttaaatctccaccaacacttgttattctgtttttgttgttgttgttattgttttgagacaaggtcttgctctgtcgcccaggctggagtgcagtggcgtgttcatggcttgctgcagcctcaaccttcctggctcaggtgatcctcccacctcagcctcccgagtagctggaaccagccacaaacagctgcccacattggtgacttgggccaccacaccctgctaactttttttgtatttttttttttttttttttgtagagatagggttctgccattttgcccaaaccctctgtgttttttgttatggccatcctagtgggcgtgcagtggtatctcactgtggttttgacttgcatttccctgatgactaatgatgtcgggcaccttttcatgtgcttattggccatttgtagatcttctctggagaaatgtctgttcacatcctttgcccttttttttttttttttttgagacagagtcttgctctgtcgcccaggctggagtgcagtggtgtgatctc

SEQ ID NO: 9896 - DNA, 1255 bp, Homo sapiens
agtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaagatggttcagattggctaatgacttacagttagctcaacggctcgtcattataggattgcagatgcgggcccggtgcggtggctcacgcctgtaatcccagcactttgggaggccaaggcgggtggatcatgaagtcgggagttcgagaccagcctggccaagaaggtgaaaccccatctctattaaaatacaaaaaaattagccgggtgtggtggcaggcgcctagaatcccagctactcaggaggctgaggcagagaatcgcttgaacccaggaggcggaggttgcagtgagccgggatcgtgccactgcactacagcctgggcaacagtgagattttgtctcaaaaaaacgattgtaggtggtgctggccgggcttggtggctcatgcctgtaatcccagcactttgggagtctgaggcgggcagatcacatggt

SEQ ID NO: 9897 - DNA, 1230 bp, Homo sapiens
gctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacat

SEQ ID NO: 9898 - DNA, 1153 bp, Homo sapiens
ttttttttaattttttttttttttttgagacggtgtttcggtcttgttgcccaggctggagtgcaatggcgtgatcttggctcaccgcatcctccacctcccgggttcaagctattctcctgccttagcctcccgagtagctgggattacaggcatgcgctaccacacccagctaatgacatgactcttaagacatgctagtgttcgtgctgaatgccccattaggttaagatcatagaaacgtggcagttggagagctgtaaaggttgcttagtttctcatttccatttctgtttaatttctagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaaggtaagtgaactgaagcactttcaatacttcctacctaaccgcgggctttccctccgagtaatgcgtaaaatgggaccacgtggcccactcctgtttttcctcttgggctctccacgtgccactcatgcttggaag

SEQ ID NO: 9899 - DNA, 1188 bp, Homo sapiens
gctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccatcgggagtggaggtgttggtcctggaagctgactcatcggagagggaaataccaaataaacatccgaggttgcatttatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgctgatgaggcccagggtgcactccttgtcagtcttgcccgttgtccctgtgcattttgctttccgctgtcaaatctcactgtctcgttttcacaccgcatcagtccccatcatcactactcctccccagagacatacagattgccctccccggcatgaagaagtcacaattctgacccgccacctctccaggggcggtgcctgggatggccacccatcaggacagccagagccagggtcccggcgtcctgagagtccagggcacctccccccattagctgtaaggtttcctgtcaggtgtgactgtca

SEQ ID NO: 9900 - DNA, 1197 bp, Homo sapiens
ttcaaagaacagaattccacactagttgttatctaggaatgcggagtgagtgatagagggggttttggtggcgttatattctaattttgaagtaagtttaaatttacagagatgctcccaaacagtataaagaattcccaaatactcttcacccagattccctgaattaacattccgacatgtttgtctgtctgtctctccacatacacacatcccttttttccggaataatttgagaatagactgcagagagtgcctctagattctcctgtgtgggtttcctaaaaacaaggacgctgtcccggatagcctgcaccgacctgcccaaatcaggacgtgggcactgtcacaccatgccaccaaatgcagaggccccggagcccgcccaggaccacaggcgccgtctgtgtcaatggctctcgagtctccttcaatctggggctgttccttcgtctctgtctttcacgaccttgacatttttttaagagaacaggccagttactttgtagaatgtccctcggtttgggctggtctcatattccttcatgatgagaatcaggtggtaggttcctggcaggagagtccctgcagggttgtcacgacaggaacgcacacaggtctgatcagtcccatttctggagaagttaacttatcatttggttgaggtggtgtctaccaggtttctccactgtaaaattaatttgttggtattttgtaattatcagttaaaaagtactgtttctggtggggagattttttggggactcggaaaatatcctgtttctcattaagctttttgcccatttgttttagcatcctgggatgattcttgcctgagggaattagtatgagcattgccaaatggtgatgtttctagttgcattgtttcttttgcattgattagttggcattccactgcaagctggagcttgcctgctgtctttctctccttcctatcaatacactcatagactcctattttacccattgggttataattcattaccattatcatttgcttcgatacccagattgtcccagatttggccaaaagcagcgcctccaagctggcccctgtgttcttttgatgtgttcatgtcattctttgagcacatctttacttcttcttcttttttttttttttttagatggagtcttgctctgttgcccaggtgggagttcagtggcgtgatctct

SEQ ID NO: 9901 - DNA, 2006 bp, Homo sapiens
ggacactcgacaactaagaacaggagttcccaggaaggacaaggatctgcctcccccactgccacttctctgatgtgttcctcaaagctggctcgagggctcgatcccttcatcggacccaggaggggactggttggtgtatccaggtaatttactcttggaagtgactgtagtgaaggtcgtggaagggctcagagggttaattggtttgcagtgcgtctttgtctattgcatgtcttggaaaactcagatcccaaaggcgctgggtttcagagaggacagtggagaccttgctccttttccttaggccgccagtctctcaaatttcagaggaggctgtttccacaactcccctgtggaaacacttggcagcggagttgctcctttgcagtttccacaccatggcttttcctttcctttcttctccattccctgatgcatcaacacttacttggagcaatttcctaggagtcagaaccagcaccagccactcggtgtcggtggccaccaaggcttaacattgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctctttaacaccgcgtgctttctcatggtctccagctaggttactctcttcatcctccttttatctggtagagttaactcatgtgtaagttccttggggagagactggaaattaagaaattgccca

SEQ ID NO: 9902 - DNA, 1099 bp, Homo sapiens
aagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttc

SEQ ID NO: 9903 - DNA, 1196 bp, Homo sapiens
ccgtagctgaccactctctagcatgtggatcagtggctgttaaataggatttcttttgcgtggccttacaacttcctccttccagtgcaggcgtgtcaaggtccttaacctgccgagacttcaggtcaagttattgcaagttctgggaagactcagcttcccagctccaccgcctgagcccaagggatgctccattttatgcctgtcacccacgccctgtgacccatgtcatgtgatcccagggctgcaggggttcgggggaagagaatccagccacggccctgccttctggggcctggcagctgggacagcagtggcgcagcctgagcctctgcacagccttctggggtccgggcttcttccccatcacaccctcctagttgccctggtgactgtgtgacccctctcccccctccaccgcctgctgccacggccggccgtataaatagaggcgaggagcagctgggctctcttggcagtcaccatgagggcgctggtcctgctcggctgcctcctggcctcgctcctgttctcaggacaagcaggtagggcccctcccagcatgacccagcccagactggtcccccacgcttcctccaaggttttctgtctaccatgggttgggtagggggtcggggctgatggcaaaccctggctcttggctggtgtcttcttacccttctcttttccccgggcctggggcctcagagaaagagctgggtgctggagaatagcagcacagttgcggggccctcaggaaggccagaggaagtgggaacggcaaacagagctgagctgtgagccagggtcagagaggagtctggccagtagatgtgggaaagagggccctcaaagtcgagacgggggagcctctgagacggacaaaatagcacagtctgggagctggaggtcgttgaggtgaccctcccacctggtgggatataaggcggaggccccactcgggtaagagaactgggtttgcgtggacagaaggggatacagtgggcaaaggtggggaccgttttgggagcagtgagatagaattggaattggtttgggataagatcggaaatagagttggcggttgggctggaaacagcattggatgcaattcagaagaggaacggggcccgttctggagtagagcctctgctcggggtgggggcttccatcagaaaaggggcttggctctgtgt

SEQ ID NO: 9904 - DNA, 1099 bp, Homo sapiens
tctctccttagagaaactgcctaacaggttgcttcaaggattggagagcgtgtaagcaaaactgctcggcatccaccgggtgctggcaacatctaataacaatatttcccaataataacagtaactattgttactagtaggaataagtcaaattaggaggcgcgatttaggcggaacctggaaggcggtgggcaggatccaggacattccaaggcaggcgtgggcttcctgagccaggagccaaccctccaggagccaggggagggcctggggccggaaggtgcggcgtgcgagcggaggacggaagctcgccgccagggtccccgtccctgccccaagtcgtcaccccctcttggggagcgcatcctggcggaggggcaagtcccacacgggctttgttatgaatgggaagctgcagccttcagcccgcggagggaacagtgcgggtctgggggaatagcaggggacccggcagcaaccagcagacctccccgcagcgctggcagcctgcgcccgggggccgctgccgttcaggcccgcctccaccctcccctccctgccggggcccccggcttcctagggcggccccagcatccgaggcgccctttgccgtcccgtcgccgggtccaagattcccaggatccggagtcccggccgtgcggccagctaagcaaggcgggagggaggaagctggccggcctccgaagtcagccccgagttacatgtgggaagcggtggctgtgacgcaagtttccagggggccctgggctcggctcgaagggagcacaccggagaggctccgctccgtgcagctgcaatggtgaaaaagcagaagccccaagcgcgaaccccaggccgccttccttgctgccgctgcacgcccgacccagccgcgccccctcctccctgcgggccggccgagcgcgcggaccctgctctgggccagtcgctgctggactccgggctgcacgggctgggctccctgcgcggtggctggcctttttttttttttttttgcaacgcttgccaacctgtcagctgatggacctcatcacccatagtggcgcatgtagctcggccgcagctcgctccattcacg

SEQ ID NO: 9905 - DNA, 1257 bp, Homo sapiens
gcactgcaccaccctgcaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccag

SEQ ID NO: 9906 - DNA, 1549 bp, Homo sapiens
caggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatggcttgtatgtcgtggatgtgccaggaacccggccctgacatgaggccaccactgccctgagcccctgcaggcctgatccgggctttctccccgaccctgcaggtgcccctccctctcaat

SEQ ID NO: 9907 - DNA, 1219 bp, Homo sapiens
agaaccttattgcattccccacgaagagtctggtgggggccgtcccgaaccctgaagaataactggcccctcgcctgcccccaccccctgcccaaaaccgaggtggcctgagggagcctcctccagcctcctcacacccagggaggctggaatgaggaaaagcgggggaggccggcggcccagcgcggagggaaagcgatccggctgactctggaatgtggaaaccgataaaaggaaggaggctgaggccctgcccctcctggtgcaagcaggctcccccaaacacccccacccacccccaaatacacagccctgctccagtcacgcgcacacagacacgcccacgccagacacacgcccactgggcagtgctcctgcagacacacacacacacacacacgtgcaccctcccccttctccaagaactcacgcaaattccacagcagtgaggggagctggttttcttggcagcacagagccttgggctccccagcccagggaggggactctaagggcagctgatggggggtccaggagaggtcactaacagagttaggtggccttgctgccctcccatgagctcagggctggccagtggtcagggatagccatccctgtgggcagcctcccctctacacacctctgctcactggcaggactggctgtctggcctgctgaggtgggagctccctcctgggctcagcagggccctgctttcttgttcccagaggctgcccagtgttgtgttgggacccacttataagcccaggcaaggacttaattttctgtacttgggacttgtcccagctcccccggggctgtcagtgggggtgacagtaatgggagctaggagccgcggacccatctcctgcccggggcatctcccttgccatctccctggcccctgggctgcgtgccagaggggccttcctcgggtaagcacaggtctgggcagtgtctgagaggctccttatgctgaatcccattctcccattcccagaatatggagagagaggtgccatctggacaaatgccctgggaccccagcccccagccccatccccatctgaccctccggacccacaggtagcaggacagctgttccaacgtgcaggagacaggggcggggtggggacaggcagtgcccggcccccaggctggcatgtgtgtgcgcatcctccctccccaggcccaggggaggctagataatggtctggag

SEQ ID NO: 9908 - DNA, 1219 bp, Homo sapiens; identical to SEQ ID NO: 9907

SEQ ID NO: 9909 - DNA, 1145 bp, Homo sapiens
ggctgcagtgagctaggattgcaccactgctattgtcgttgctgttacttctgttactccggttgttctggcttgcagaaaacctttcgatgaaggtaagggtaggaagcataaattctctacgaggtaatgtcccctgaggagagaggtgaagtgtgaatctgtgaagaatccagggtgcctgtgaggtcaagcgaggatcaacacaaacattttcccagcatgcgcgacggcgggagagttcgtgagacttttggaagcacttcacgccctacacttagcattcagtttggtcatctcatccctcttctaggtgctagtcacaggcccaccccaacctcataggatgtgtttgcacacagggccacttaataaatgttatggctgccttatttgctgtgaactcttgtctgtattcctgggccttggtagacctgggatgcccagtggctctgcctttcactgtaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaagtaagttcctcacttggaagaattattcaaattttagactaagtatgggtcaaacaaatttttttatcagtttctgtttctcagaaaggcaaggcagcttaaatggagtgatctggaggcagccattttagtagaaaataatttcagtatttgaaaaatcgcataggtagtaatgagtatgtccattctgatggtattcttaacagttgcataatgaggtagcacctaaggctttcagagcccatgagggtgtgagtgttgtctctcatctgctacagtattccaggagagttctgtccggtgggaaggcactgctgatcctctctcatttatgtccttataagacactgtcagagtggaagagagaggggatatatttatgatctaaattatgattgtggatcattcaggctgtttttaagtgccatgtacgagtatttatctgtgaacattttcagtctgttgaaagtacgttt

SEQ ID NO: 9910 - DNA, 1518 bp, Homo sapiens
ggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggttcaag

SEQ ID NO: 9911 - DNA, 1210 bp, Homo sapiens
tggggaaggaacacagagccttccgagaatgggccagccacgcatctccccttgggaggcagtgggggcccctccaggaaggggtgctcaccccatctctcctctcttcccctcacagatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccacgcagccttccttcgaagacgcacctgcccagcccagcccaggggtgccgtggaggaccaccctggcagagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaatt

SEQ ID NO: 9912 - DNA, 1573 bp, Homo sapiens
caaatgtggggtacacagaggtccagaaaagcatcccgggctcattgcccgggccgtgcccgctcccccatttctcccccacctccccgtggtctccaggcatcccgcacccatctcactttccccttccttccaggagctcggtcaggcaggccggggtctcccgaaaggagcactgacgagcgttgtgcccctcaacctggttttgtggggacagagcaggggcccccgcagtctgacttccgttccccagaacctgggcattttccttcttcctcagccttgttgattctgtctgctcccagtgagggaagaacagtggctcttagccagggtgcccgttagaaccacctggagcaggtcagcccccagaggcccgggcagggcacagctcccaacagctcagctctccctggtccaggacgcccctgaccgtgtctctcgcctctggcatggctttgctctgcccccgctcccagctcctgtctgtcactaacccttcactctccacctggggccaggcgggactgaaagccagggaggggctggttgaggccagggctggggcggttcttggcagatgccctcgtgcccgtcatcccaggcaccagcgtgggcatttgggcatccagccccgtgctggagctgatggctgaggcagggagggcatcggtgctgccagggagctcttggccaccctctgagggtgggggagtctcaatcccccaaagaacagagtggacaggaggtcatcaggaggagcgtctggggagcaggtggtccctgggcatgagccccctcacgcaccctgtccctacagaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacaggtgagcagcagccaggccaggtgcatggcagggtgtgtggtggcgcgcgtgcggagcgggtgtctttgtggtttcaaatcagtttgtgatgtgttctgtgtggcgattccccagaaggactcggagaccccgtatcaggttagactcatgggtaaagtttattacggcaaagaacgcagcagacgaggcaggaagagcgtccgggcagctggaggctttgatcccccgaccagggccacaccggcgtgcaggcgcatacgtgctctcgagcaggaaactgcaggggtcggtgctgtgtctctgctgaggggagcccctttgagcctctgggttcccagacttcattggggggctggccacgtaggcccactctgccggtgaccagccagggcagccgaaactcaggacctgacagtgacccaggcacactcactgctcttgccgttcgcccgtgacgagccacggggcacggtccctctccaggcgatgagtgcatcatccatcactcatacgacagccttcggag

SEQ ID NO: 9913 - DNA, 2415 bp, Homo sapiens
tacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacacagctgtgccgcaggagtcctgcttccctcgtcctcggcgagatgggtgggaggagaaggcagcggcggggccggggtgggttttcgggacctccgcgtccggggtgagacggacttgggagtggcggcgaggtccgcggcagggttggaaccacgaccaatggagccaagcgggccaatagggaggaggagcggggacagactgtcctgccggccaatgagtgagcgcgagtggagcagagcgccctatcatatcctgggggcgccccgggagctccgcccccaagcgggcgccccaggctggtgccggccgcgtccctggccagccggagcaagcctgactcgtgcagccgccggccgcgtccctggcca

SEQ ID NO: 9914 - DNA, 1199 bp, Homo sapiens
gggagaggggaggcctccagaagctgtgacttttctttccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtaacacgcctgcacctgtcaggcctggagcctggggccacatctcctctgtttcacactgatgacagcgtcagtcccacacggcctttctgccggggaccctggggaaggtttcctttcacctgcatagtcagtgcgtggaaggaggaagagccagtctgtcgggggcaggtgaagggggcctcccctggagagaggtgggtctgagcagaggtgagggtggacagagaagccctgtctgtggcattcttgggctgtgaccgtgagtctttaccctgggcaggtgaagtgggcaatgcagccaagatgatgctgatcgtgaacatggtccaagggagcttcatggccactattgccgaggggctgaccctggcccacgtgacaggccagtcccagcagacactcttggacatcctcaatcagggacagttggccagcatcttcctggaccagaagtgccaaagtgagttgtttttggcccctcttcttgcatttggtgtttgattagagcagggtactaggtcagggatttagtgagcgtgaaagatgcccctccccagtcagtccctgaccctggccagaggaggttcagaaacacagtgggcgggatttggggatataggctgggagctgcagccctcaggtgtctaagggtgagtgaggagccaagaggcctaggctatgtggaactgagccctgagtatgttttaggtactgacacctggtggaccgtaagtagtttttagtttcaggtccttggcttttgtctgatactggctttttctcctcagatatcctgcaaggaaactttaagcctgatttctacctgaaatacattcagaaggatctccgcttagccattgcgctgggtgatgcggtcaaccatccgactcccatggcagctgcagcaaatgaggtagggtagatgtggcccaagccccaaggcccttcagtttctttttctttcttttttttttttttttaacggagtctc

SEQ ID NO: 9915 - DNA, 2590 bp, Homo sapiens
ggagtagtgtacacgaataactgctggctggtgtctcatggcttgtttgagctctagaacactcagcatttggggacttttgctatttaggtgtctcccttgaagtttggttactactgccttaaggaaatcagagagcatgaaaaacttgcgttctaatttttcttactcttttccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacattttttctcactcttttctttctaccatgtggaagtaagtagttcttcctgtaggagctgttacagatggaatatccattttggctgaaagccaaggggggggggcgggggagtaagccttgcatgcaaaa

SEQ ID NO: 9916 - DNA, 1354 bp, Homo sapiens
gacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctcccttgccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcactggtatttaggtatacaaaacagttgattattcaccacgccaatatctgggtctctgtatctcatgtagaacataagaaaatgggaactaatagggaaatttatttatagcatgaaaataaacctggtggctggagtctgcttgtacggtccacatgtttcttcttttgcatgcaaggcttactcccccgccccccccccttggctttcagccaaaatggatattccatctgtaacag

SEQ ID NO: 9917 - DNA, 1618 bp, Homo sapiens
tgtcagaaccatggtactctgttggggtgtgaaagtagccacagatcatctgtagattaaggggtgtggctttgttccaataaaactttatttacaaacacaggctgtgggctggatttggcctgcaggctgtagtttgtgatccttgattcagacagtttagcaaggctgcaaagaacaccgacacccccttgttacccacagatgggtgagactgcgttggccagaggccgagaggagggtgctcacaggggaatgggcagcacgtagaggccgggaggtgctccagggcaccaagtgtgggaaagtgggacatgcggggaagtttccagaaactgtgatgtcaagttggaggcggagtgctgctggggtgtgaagggtctcgagtccaagtgagggagttagggacttgggaggggttgttgttgggtcggggacctggggtcagccaggtggtgacctgggatggggtggggacaggcaatgaggtaagctctgctctttatttttttgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttactt

SEQ ID NO: 9918 - DNA, 1704 bp, Homo sapiens
tttcttcatccccaccaggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcc

SEQ ID NO: 9919 - DNA, 1158 bp, Homo sapiens
gccttttccatttatctacaatccacctggaacaggtgggggtggggagatgtcaggaccaacttccaccccaccccgtgttgacctctgaggaaatcgaggttttccttgtcattctgccacatcagccagccattcacatttgtgcatctctgcttttgagaccaaggggttgtccacactgcccaattccaagctgtcttcataatcatagctttacagtatgtgctttgttcgaataacagtaaaaccttaactgttacctccatattgtcattttaatgtccttaagaaagataccaatgacctttggccaatgagcaaaggtgctaacagcacatttacctacagtcttggctacagggggagagttactgttagtgttgtttaccttctctgctaatcctaaatatgctgatttaaataacttacacctgtgttggctacattataaatgaagctttagcacttgacttttctctctctctctttaaagtatttgaatcatttgtggattatgtggcagtagaacagctcgatggggacaataaatacgacgctggggaacatggcttacaggtaaattgagtgttttgtgctagtgtcctgttgtagcgttcttctttattttcaattcttttaattgctaaataaaaatttgcttgtgccttttcatgtgtttctggtatttagaatatacaaggattctgtttgtaggataattgaatggggagggagagggggatgttgggagatggagtgcagctggtttatcctgtagaagcacatccagcagtccggagggtcttgtggggttttaggcatcttgtcctttccccgttcctcaccttactggtgtcactgctccagttttccctcagtttctcctggtcacaagtgggatttcttagtaagttggactgtgtttaggttgtgtttctttatttttaaatgtatttttaatgaatttagttttctgaggatcacgactttagaatgagtagtgtgttctctagggttgtgtcccccaggtttctgggcatctgagagagcagtgagcatggtgggcgaccaggtggccagcccccgcttggatgaagggaaatgggctgtttctggctgctggtctggctggtctgttggatctgcagtgtcctc

SEQ ID NO: 9920 - DNA, 1102 bp, Homo sapiens
ctccccatggagttgcgtaagtttttctttaatcaggtgctgttaaaaatgtcttttgtgctgcagtgaaagaagctttagcgtgcatgtaatagagatgcacatatttaatcagtaagcctcctctctgcgcttgccctgtggcacacagagtcacacctgcttgacactcgtttaacagattgattgagcagtttctatatgttagacccttggaacataattgtataattatggcaactagacagctgtggttttctgttcctaaagaatgtacactcagctttcatagaggagctaagaccggtacataaatacccagagcagagatgctccgttgttactttgatgagggcagggaggaagtcctctccgagtgtgaggaaggggggactgggggaagaggtgagcatcaccgacaactaacatggtgagcgaggagtaaagaggggtgacaaggccgttaggtgtatttgagtgtttccaaggctgggagctaacccctggagtggcaaggtgctggtgaatggtactgcgcagtaggtgtctcccccagcactggtcccgcttggtgacggtcgtgtgttcaggtcgtggcattgtgtacagagggagatgggcgtggaggtgggaggattgctttgctttctggcaccgttctctgtggcttccttttactacttggggtgggggtgggaaggtacgagacacagttaattctgagaatcttatcttgctcccaaacaaccaccaaaatcacaaaataaaaaaagctctgggagtttagaagtctgaggtgaaacttggtgaatacacacttctgtttcttcttgtgtgtgtgtctacagaaaagatgagtttcagctttttccacgttgtgctgaccttgcgtgtgataagtgtaattatgtaaccaaactctaccatgaggcatgttgggtgtgagcatgcaggtctccgttaagtgtctgttggtgctgggcttgatcagtgacaggagtgccactgtcagcaggcaggtgcttcgagggctgtgcgaatgtgggggttgcatttgcaccagttcacacactggagcaagcagaagggaatcggtgaccat

SEQ ID NO: 9921 - DNA, 1274 bp, Homo sapiens
atatatcaagtaggacagtgaaaaatgtttccttgcaaacttgtagtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaactttagcatttgttacttttttccattgcgtttactttcaaatgcacctaatgaatttgtcacccagtcgcaacttttcccttctctgtcccattgctttctcctttccccgacgcacagaataaacatgaagctcagcagtagaagcgtaatgatttccctcaggaaaaacttctgacagctaggtttttcaagggtttccctgtgctagctgagatgcaaaacaaatcatggaagattgcatacctgtgtggtattttaaaaacaagttgactttttcagtttcttgaacggttaagggtggatttaaaaactagacagtttagttttggggaacagaagctctcttcgtcttaagccagattctctgattcttttagacgtcatagctccttagttctgctcctgtcgccctaacttggcatggg

SEQ ID NO: 9922 - DNA, 1224 bp, Homo sapiens
tacacgttaggtacaatgtacactacttgtgtgatgagtgcactaaaatctcagaattcatcactatataattcatttatgtaaccaaaaaccacttgtaccccaagaactattgaaaataaatagataaaaaattaaaaagtgtgctgtaaaagaaattaaaagcagcttaactaatgacacattatttctcacgtaacagaactcgagaggagttggatccagggttgattccatggcgcctgggctccgcatcagcctctcttagccttttttgccttctccctctcggagccaaaatagctgctgctgcaccgtcatcacgtctttcatgtcagtgtccagagcagtaaggcagttcgagaatggctgttgggtggcaatcacaaatgtctggggcatgtgccatgtgctagtcatttttctaggtgctgatgttttgcttcttctaatcctgagcaacatactctgggaaggtgtcatctttgagatgttaagtgatttgtctaaggccataagctagtaagtggcatgatgggaatttaagtctaggtttacctgactccaaaaagtctgtgttcattctaccaagatctagcagtgtctagatcagggtttctcaatctgagcactattgacattttgtgctggacagttccttgttgtagggggctgtcccatgcattgcaggatgttcagcagcttctgtagaacctatctattagatgccagtagcaccccctcagctgtgacaatcaaaaatgcccccacacattgccaaatgttcagatgctgcaaaaatcacctgcagttaagagccattgccctatggagtactctttctgtcaaggctcaatataaaattgcataaagctggacgcggtgactcacacctgtaattccagcaatttgggaggctgaggtaggcacacttgaactcctgagtccaggaattcaagctgggcaacatggcgaaatcctgtctctactaaaaatacaaaaaattagtcaggcgtggtggtgtgcgcctgtaatcccagcttctcaggaggctgaggtgggagaattgcgtgagctcaggagggcaagactgcagtaaactgaaattgtgccactgcactccagcctgatcaactggagtgagatcctgttaaaaaaaaaaaaaaaaaaaaaaaaaaaaaaaaaagcctgagtcctgagcctttaacctggtgaccaacatgc

SEQ ID NO: 9923 - DNA, 1166 bp, Homo sapiens
cccaggctggagtgcggtggtgcaatctcggctcactgcgagctccgcctcccgggttcacaccattctcctgcctcagcctcccgagtagctgggattacagttgcctgccaccacacccggctaattttttgtatttttagtagagacggggtttcaccgtgttagccaggatggtctcgatctcctgacctcatgatccacccgccttggcctcccaaagttctgggattacaggagtgagtcaccgagcccggccaatttccctaatctttaagcagagatggtaactagtactcacatctcaggcatgtggctggatttacataggataagttaaaacctcaaagctcaaatgccaggagtatattaggtaattcagtctttgtaagtttcctttctccataccttgcagaaccatttacataatggaggtgaagcaccttagcaagctgtgcagtgttgtatcctgtggggaggtgcctctctgtttttcttctcctggtgcttctttacaaaattctgggttccaaccatgtggaactactgagactcccaaatgcattatgttccccacattccatctgagtgtcacattctctccattgtttaagagccagcttaagtgcattccttcaataatcttcctctatatagcattcccccttccatcacgttggttctcctttcttcttcgggctctccactaaaaccacacaccaccttcattattccttatcacttaataacacatatatttgcttatattccttcctctccaacaagagtgagttcacccaggacaggaactttgatttatctgggatctccagtgcttagcatataattggaattctagaattatgtcttgagtcaataaatgtgattattattactattattatcaaataagaattttctctaaactcaagaaaaaagaaagcaatatctcagtcaaatcaatacaaaagaagcctgagtgttatcataaaatcctttggagagtggaccagtccttgaccatatcctaagaacaatggcgttaaatgtagctattactttgccttcttctgttaaaattacttattctctcctaaactattttgcctatccatattctctctgtagacacccagcattcttaagtgaaccaatagggtttatat

SEQ ID NO: 9924 - DNA, 1607 bp, Homo sapiens
ctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctcccccgaggcctgtttcacgtaaaaaacaaatgggttgtgggatcgtgggattctgctgtgtcggaagcttagtcgattgtagaaactcccgtttaagccatttctgcctgtgaagataagaaagcctagaaaagaaccaaaggggtgagtgtgcggcttcactgcagaacacacaggcttgttttcaaacaccacagtccaaacgcttttcttcagattgaggaaaaatctaaaagcaacagagctcaggctgggcttcgttctaaaatcactgcatatgacacagctgggtcaaatcaaaaagcccttgaagagtccttgaatcacccagtaagacagaatgtggggtctgtgtaaattccctgtgtagtaatatgtgcacagtatatccagtaatgtccagtgtcatgcaaaccaactttcaggttttttaattatataaaaaagagggacagatgtaaactctacgatcatcctctttgccatgaggtgcttgctctgtttgagacacacaggatctgagaccacgtgggagaagagtaaattcctgttttccctccactctggggcataaaagtgggtgggtgggaaacaagaacaaatccccttgttctttccctcccttgtctcttccctccccgcccttccctaggaccatacatatgatcagatttgcacatgttcagtgtgaggaaggtgtgacctcgccccccgacccccagctcctcacgccaagagcaatgaggctgcaaagcccagggcaggcccattgcccagtctgcttcctgcctggtcacatgcctggccaccccagggaacaggggaagcccacccagaccccgggcccctgtgccccaagagctgcatttttcagaattccccagttcctccacacgggtgccatgatccatttctcacctaatgctggtgaatctccagcccctcgaggccaggcttctgaaagtcacctgggcaggcctgcaaggggaaaagtcaaccatggttttctgtccttacacgcgagtggggcgatcctgctgatggaaggccagagaaaacccacaaagtacagaaaacctgcggaattggttgcttgatgtcttggcataaagcagtgctgttcaaatttaggacggttctacccatttcaggatgaacctggtcaaatttcaaagacttctgtctctcacttttagaaatatctattaagttaaaaaaaaaaaacaaaacaaaaacaagctgggcacggtagctcccgcctgtaatcctagcactttgggaggccaaggctggtagatcacttgaggcaaggagttcgagaccagcctggtcaacatggagagaccccgtctactataaatacaaaaattagccaggcatggtgttatgcacctgtaatcccagctacttgggaggctgaggcaggagaatcactt

SEQ ID NO: 9925 - DNA, 1206 bp, Homo sapiens
ggtctcaggccctgcagcccacaggcatttcatttcaccctcttctgtctgccccacccccgtattcagtaggtagtaccttgaaatgcttttggagtgattgggttttccagagcccatgctggtttggttgggacagacagactcagggtctagcccttgctggaagcatggcctgggcaggtcacttcaccttcttaggtctcagctgcccggtctgtgaaatggggctgactgctgggcagggattattatgaaggtcacctgatacttggggacaaggtcctggcagatgacgggtgctcagttcaggtaaagtaacccaaacctgaacctgtgaataactgaaaacaggctactccccctttgatttttttttttctgtcttgttataaaagcacgtaccagaatcaaaacacccgaagaggtgggctttattgcgtttctttcttttttaatagagagtcatggtgtcatttctgggtgtggggcatctcactgaaatgactctgcaatctcactcttctctgctctctgaactgttggtccaggccatccgggtgttcttcatgctgcgttccctgtcactgcaattgcgaggggagcctgagacacagttgccgctgactcgggaggaggacctgatcaagactgatgatgtcctggatctgagtgagttggctgctctgagtcacagcagggggctgggggacatgggacatgggacaccactctgctgattcacacgccactgggagggtcagtgtgcaacctacattttgtactattattgagctgtgaccttgagccagcggtgtgcatgtcccatgcaggttttgaagaaaaggcccctgggttctctgagatcagtttgagggttctgctttcacacagctggttctctaaaaagtctctgcagagcacctggaggctcaagcaagggtgaacaaactccagggttcctgtcctccctataaacatagtggcatcggtttggttggttttatatattaagcattttctatatgattctaatgataaaagggttctgctgctaaagaaagaaacttgtaaaaagcaaaacaccagtgtttaggtaaggatgaaggctttggaggctggagaaccacgtgctcagcccataaccttgagctacttgttccgctgtgtagtgcctcattgttctcatctgcagcatgaggctca

SEQ ID NO: 9926 - DNA, 1515 bp, Homo sapiens
ttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgctta

SEQ ID NO: 9927 - DNA, 2151 bp, Homo sapiens
aaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtacaattttcacctctgatttcttcatatcatttaaaaagttagtctgtcctgttctccttattcctttcagacaccagtgtggcgctgacattggcaggtggaggggagctgccagggagctggggggtggctgagggctcaggctgcttggggtggacctctctctgggccgccaggctttcagctccatccctgccctccagtttcctctccatggtcgccaccaggatcttgagccacgtgttctcggtaaggaggttttctgaggcatcggccagctcctgcagcttgcgggccagctcctgcagctcacgtgtcttctgctcatagagggcctgcagctgctcactgtgtgcgtggagcaggctgtgctgctcttccagggcccgctgctgctgccgcagccggtgctcatctctgcgggcactggagagctgggactccac

SEQ ID NO: 9928 - DNA, 1279 bp, Homo sapiens
cagtgtatgccgaatggagaaaggaggaatttggtagggaaggaaacctttcatttcaagttttaaagtatgaactcaacagtagactcagagcttctacatatgagtctttttagccatcctctttcaaatctaggtgaagcttgtttcttacattagacacatttgtgaaaaggctttatgtaaatattgatttttctatatcaagttacatattataaatccaagagttcctcactgtgtaaaagaaccctgtgaccagtcactttttgaagggcataaatctgtcgatattatagattactcccaattcatgttatctaaagtcattttgatgtgttgagctttcttaaaatgaaacaagcattttttttttaaatgggaaagagactccagagaaatggggtcagtgttcctacaagcatgtatttttgaggtagtctgtattagattttcctgaattccattcagtaatgctcaagtgtttaatgacctcataatgtgttcactttgaatttaagggtaattgaaagaagccttctttagatttctttccatcttctgtatcttctctgaaatgtttagcctagctgttctttgtcctgcagttagtgacagaattcttagggagcttgtaaaaaacacctactgtgtgtcattgttggtttagagacttaactcataaatcagctgtctctaggctagtttcagaatttaggctttattcagattaggaaataattcttggtttcatgtttcaaaaacatagccaactaagtgtttctcagatgctgatcatgaattctctttagtattcacatgacattcttcacttcctcttccattctgcacgctgcattgcccattgcacctcaaaatggagggagttagaagaaagaaaaagaactgaaactttagctgagtgcaatggtggacgcctgtagtcccagctactctggaggctgaggtaggaggatcgcttgagcccaggagtttaaggctacagtgagctatgattgcagcactgtactccagcctgggcaacagagtgagaccctgtctctttaaaaaaaaaaaaaaaagtgaaattcaaattagtattgtttcagatgaagcaaaggactctgaagatggcagaatttgtggtaaaactgttggttcaaatcaggtttttgattattatgggttttatgtatttttccactacatataattttttcttaacctttaaaaaaagaaacttaaagaaccttaataaaggaaacaaaaaactgtagct

SEQ ID NO: 9929 - DNA, 1244 bp, Homo sapiens
agcctgtgccgcacggaggctccatgctgcccttgggggcagcatttgaaggaccaaggtcaaaatctaaatgatccttgactctgtagtttctgttcccttagatatgtcttggtccttttatgaatacccagtgacgtttaatacctgtccttggacagggtgatagaggttgttatcgccaccagctggcagggagaattatttgttgataggtgggtctgtctcaaggcagaaagatgaatcacacgatatggaagtcacctcctgcaaccacttttgttttttcaaccacttgtgaggaaatgctgtctctggagaagcgggtgttagctgcacagtggggccaggccccgctccacgcctgggttttctcacccttagtggtggggttggaacagcactgatgtgccttgagcttgccccacctcacgagctctcctttatcctctgtgcctttgtccttcacaggtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgaggtaagagctgtgatgtgaaaagcacctcatgaggagtaggaaagcctcatctacctggctcctctcatcccacactcagtcatttactctggcagctaatggctgccacgaggggcagctgtggctctgagcattgctctttgcccctccatatgggcaggagagagcccgtgtctaggacagggactgccgcagcctctctggccatatttattgacagctgttggtgtctggagtgagtgggaagaggcagggaagccacaccgtgcccttctagagaaggaccaaatgccctcttctgatgtggctgctgttgagcttcctgtttagggggtgaaacagggagtggcaggaacacaggccgagtttagtgtggcctaggagatgccattgtcttgggggtttggccagactgccagccctggccatcctcaggacagcagaggagagcgagcagcagcagcgatgttgggacaccttgtttctctgaaccttccctgtcgtgcagaagccagagtggttttcagaggcagcgccatcggagcctgctgttcctgcctgtcttcggcttc

SEQ ID NO: 9930 - DNA, 1222 bp, Homo sapiens
ttgccactgtggaatgctgggttttggcgggggttctgtggtttgtttcctgttgaaggggcttgattacaggtgaagattaaccctgatttccagcaaagtgtgaaggtatgtttggagtcaatgagagagagagattcaagaagaaacttaagaaaggttaaaagaaaattattgccattgcttgtctggagttgttaaaagcgattgaggacataacttactgataaagttttgagcctgggagaattgtactgtcaacaaacagggtgtggaaagacctactcatggggacagaaggaaatttcagctttgaatgtccctgaatgaccactgtacaatcctgtcaaagctactgcaactccatcccttaccctgtttgttgtttaaatggaggggatgttcaaccccaacctgaaatttttatcatgtgcttaggctttttgaaaaaatgaaaggcaacaagatgcattaattgtcaaattgtaatatgtcttgctttaaaatatcctccattacactgtggctgacagtgcctcagttacctaattctgctctttttcctgcagcctggagtactcgggtactttgagttcagtggctcaccccagcctcctggttatttgaccttcttcacctcagcattacattcattaaagaaaggtaaaaaatgattcatattaagacattgttacttcagtagaattgttacttacatcttttccatgtgttattatgaatatatattctaatttgcttgattccttttctcaacgtatttttatttattttatttttttttagatggagtctcgccctgccgcccaggctggagtgcagtggcgtgatcttggctcactggaatctgcctcccgggttcaagcgattctcctgcctcagcctcctgagtagctggagttacataggtgcctgccgccatgcctggctaatttttgtatttttagtagatatggggttttgccacgttggccaggctggtctcgaactcctgacgtcaggtgatccacctgcctcagttcccaaagtgctgggattacaggcatgagccactgcgcccagccgtcagtgtatttttaataattacattgtttagtgttccatcattagcaaacaggaaatactgttctgtttcacatatagtctcgcaaatgttttgctttttaaaaatatagcttgaggctgggcgcagtggctcatgccc

SEQ ID NO: 9931 - DNA, 1194 bp, Homo sapiens
aagccaactccagctaataagcttaatgttttctcaaagttgagttgattgtaagcatctcccgtggaaatcttgttaatggtagtttacatgctccctcaccgtaattctgagcttgcatgctggtggctctaaagccctggagataagtggcttttgtggagagccaggctgcagaaaaaggaggatgaagtctttgggatgtggggagcaggaatatggattattcagagacatccttctctgctctccactgcccttccagcctacacctaggggacagaatctcagagaattgtttccaacgtattattcatgtcttgcatttgctcagccagatgttgcctttctagggcagtgattttgggactccattttcttattcaaaagaggattttccttttaagcttcattctacttccacagagctatttttagaagaagataaactaagcaatcttttctgtgtttgctcttttttagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtaatgctcacattcagcttaagaatcaaatgactgtcagtcctatatgtagggcaggatgtccccacagagacaccttgcccaacgggcagactttgccaaggtgaactccaggagtcgtttctaagttacagagctttctataaagcaacagaaaggatttccaattgtggcgattgtactccaaggcaagtgtgggagcagattctgaatctcataacacaagccaatgcttatcctggggtgccatactgtttggtttcagcattgaaaaaggtagagggactgaaaatcctagttcttgcatatccatttgatacttgctagttaggtattttaggtaagaaaatgtatgtatgatatgactgcattgtaacaaggccgacctttttaatatatggaccagaactatattcagcagataaggaatgccacctttgggctaggtaagaaagatatataggcaaataagtcacctgttatggcagtggttt

SEQ ID NO: 9932 - DNA, 1293 bp, Homo sapiens
taagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaa

SEQ ID NO: 9933 - DNA, 1092 bp, Homo sapiens
attttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctct

SEQ ID NO: 9934 - DNA, 1251 bp, Homo sapiens
cacacctggctccccttcctggcctgtggtcatttgcttttcatccccagacttaacccgattctctccctgctctttcagcgacatcaccccgcccggagagcctgtgaacagccggcccaaagcagcttcccgcttccccaaactgtcccggggtcagccccgggagacccgcaacgtggagccccagagcggtgacctctgacctcgacaaaaccgcagccacgggccctgtgcgtggcaccagctgcgtccaccccagccactgccgctggcccctcacctcagcgtgacaaccacgtccacctggtgatcctgagagcacacgattcccaacagttacacaacaccccgattaaactaatcagtcttcgagccgcatgataccgtgacccgagagaccaaggcagcacctcgctggagagactgggacacacagtccttctgcttctggggtctaccctgggctgcaagggctgttcctccacctttctgtagttcagggctggcaggagggtgggcaccaggtcaggctgggtgcgccatggttgagaggcaaaggtgatcccctatataggaaggttcatgcagagccagcctctccactctttcccacgtggggactagaatgactattagcctctccttttgctttttaaggttattacctggcctaacctagggatggctggctttgcgggggggggggggggggggggcatggttcctttcactgcattttccaccaacagtcattagacacctggcactgtcacagctcacttttccagagggatattcctgtggctttggcaaggagccattagtgatgtgcaacttgagttcagagaacttcccctacctcccccatggctggcttcaggaaggaccagtgccctccatagcctgaggccacctaggccctcgccaggcttggagtggggggactcagacatctggcccagccatcagcagcaacctagtaacccggcgtcatccagcgtgtccaaagtagcattggccctacagtcatgagagacttgggtcagggaaccactgcagaaggttccagggttttcaaaccaggctccatgactatgaagttggacccagtgtggacacttaacagatcatgtgtctctccactaaaaacattttccatcccgtctgcccccgacattgtccttgataacagaactctgcatcccctaagacagagtcctctgttcctcccatgtcaggtggctctca

SEQ ID NO: 9935 - DNA, 1348 bp, Homo sapiens
tcatctcctttcctttccagcggaacgaacagctgtctcccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcacagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctc

SEQ ID NO: 9936 - DNA, 1237 bp, Homo sapiens
cagagccacagcacagcacagagaaactcagtttccagggactttggcagggatgttggtgctgtgggaggattcagaccccatctcagccacttgctagctctgtacatctggtcatattaccccacttctctcaatctgttcttgcatctgtaaaatggggtagtgttaccaccttggtgggcttttaatgaagattatatgaattaaatgcccgctgtattgccaacaaagaatccagcatggtgttcagtgaggaatactgtgcatggctacagtttaactcctgtgaaataaatagatagatgctggaggcagggaggtgcttcctccgcgcccccatgatgtttctgtggtttcactttcccatgctgggcactgccctccctagacaagacctgtctgtggactctttccagcgcagctgtttagccagacgctggccccgtctgcagccgtcacaggccctctgtctgtctgctggtcatgtcatgctctcctcaaggtgccgtcctggtcctgctgttcatattgttttgttctttcccaccaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcct

SEQ ID NO: 9937 - DNA, 1205 bp, Homo sapiens
aaaaaaaaaaaaacaattacaagatgagttgatggatggaaatttcattttagattgttggatgtgtgtgtgtgtgtggtaatcaatgtagaactcactgtgatcatcacaattttttttgagacacagtctccctctatcacccagggtgaagtgcagtggtgcgatctcaactcactgcaacctgcacatcccgggttcaagtgattctcttgcctcagcctctagagtagttgggattacaggcacacaccaccacgtctggccaatttttgaatttttagtagagatggggtttcaccatgttggccagcctggtcttgaactccttacctcaggtgatccgcccacctaggcctcccaaagtggtgggattacaggtgtgagccaccgtgcctagcctgatcatcacaatattttgtgtaaaagtcagtcctcatgactttttgcgtctgtgtgttattttttaaggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagtaagtatgttttaatggttgtcacaacaggggatgggaaagaaataccaagtgagagaaagatcctcttttatttctcacacttgaaataaatcctccatccacccagacccttcagactctgctttgagaaacctagcttaagcagtgaataggacaattacctgtgttttgggggtgggggttgtggtgctcattgttaaaagtattttcctatatgtcttatctctatgcaataatataccatttaatttcagggggaggggggcaaaggattgtaataatcaaggaataagcaactgaatagaaaagggtctgttttaaggtaggcaggcctgtgcaaacctatcccctaaatcagaggaagctgaggggctgaaggaagaagctggcaaattcagtttctcagaaagaaacacttaataaggccttgccaacagaagccctgtctgtgtcttggatggtagcgagacaagatggtggatccccagactcagggcttgtatacatagggaaggggcatacatgctt

SEQ ID NO: 9938 - DNA, 1116 bp, Homo sapiens
tggatccctttctctgaatggagagattgagagggatgtcgggcagttcccattagatttagtggccttcatgttattcagaattgttttggtgatacctcacccctgtaatcccagcactttgggtgggtgaggcaggcggatcacttgaagccaggacttcaagaccagcttggccaacatggtgaaacctcatctctactaaaaatacaaaaattagccaagtgtgatggcacatacctgtaatcccagctacttggaattggaaatcgcctgaacccaggaggcggaggttgcagggagggagactgcaccactgcacttcagcctgggtgacagagggagactctgtcttaaaaaaaaaaaaaaaatcatctgtaaaataaattccgggatagtcgttttgttcaaggaaatgttttgtaaattgagctcacactatataatctttattgtcctatcctgatgtataatacagcaggtataattacaccaagcgctatagttataaatatggcatgaagtgaactatggccttttatttccttccagtgtgaacacagcaggtgtgagatgtcatcttggaagacaggccttgcagaaataggcctacatccaaaatattatcttgtgactccatgaaccattcattaaccctttgtatctttgagtgaaaattttactcaaaagttgcatctggaagttcgaagaaattacttgaaataaaaataaagatttctatatagataaaacctatatgtagagaaaaagcaattgtctagaaaacacaaaacttctgcattgccggatagaatcttctagccatgggccgagcgtggtggttcgcgcctgtaatcccggcactttgggaggccaaggtggatggatcacttgaggtcaggagttcaagaccagcctgacgaacatggtgaaaccccgtctctactgaaaatacaaaaattagccaggcacggtggtgcgcacctgtagtcccagctacttgggaggctgaggcaggagaatcacttgaacccaggaggcagaagttgcattgagccaagatcatgccactgcactccatctgggtgactgagcaagattccgtctcaaaaaaaa

SEQ ID NO: 9939 - DNA, 1149 bp, Homo sapiens
gacatcacctgcttcctggggagccctgcagatggagatcacgtggtgggctgtcaagtgtctcagaaatgtaatttatgacccgtcctgcctcttgctttactggtttcccttgagtctctccaggtccctgctctaatctcagtttccccacttcttccaggaccggcagagaacaaatgccaagaactgttgtgcaagtgtgaccaggagattgctaactgcttagcccaaactgagtacaacttaaagtacctcttctacccccagttcctatgtgagccggactcgcccaagtgtgactgactaccttgacttgaaatgctcttttgcacaaggaaataaagcgtcctctcagtaatgaacaacagcattcagttatttgcagaagggaaccgaagccaagtgataaagccacaaccttgtgtttgctttccctcccaatcccagaactcaggactggagcccatgtggtttgcagttaaaggccaaaagtcctgcacctattttataaaactatgactgtgtttatcactgtgttggggtcggttccatttttgaggttccatctttatgaaaagataacctgtcttctaacctgcttggatggctggtagtcaaatgtgaacgaacacctaccgtgtgcctggccatgttctatgttctaggctgcagcaatcaacaagatggccatacaacacccacccggtgaagttcaagtccagtagctgttagcttaagaaagagtattcccttatcccactacaccttaaaatgtatttgctgtcctgcagcgttggctcatttctgtaagcccagcacaatgattacaaaagtggtacatacttgttgcttcttaaaaaaatgaaagtgcagagaaatatagagcagaaagaaaaatcactccaattcccacaattcagaataatctgttaggatctatagttttaaaaatgtagttcaaggccgggtgctgtggctcacgcttgtaatcctagcactttgcgaggccaaggcacgtgaatcacaaggtcaggagttcgagaccagcctgaccaacatggtgaaaccccgtctctactaaaaatacaaaaattagccaggcgtggtggcacgcgcctgtaatcccagctactcaggaggctgagg

SEQ ID NO: 9940 - DNA, 1252 bp, Homo sapiens
gggaaacagcttagataaggccaggtgtacagtagctcccacctgtaatcccagcatttgtggaggctgaggtaggaggactgcttgagcctgggagctcgagaccagcctaggcaacatagtgagaccccatatccacaaaaaatttaaaaaaggagtttgtcttcctgtagtagcagacttgagaggttgaggtggcagtatcacttgagcctgggagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgcagtgagctatgattgtgccactgcagtccagcctgggcgacagagaaagaccctgtctcttaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcatcctggcatagccagatgacttccgtgcccctgttgcaataaccactgcttccaagtctctatagaccaccccttgggtatatctaatgtaagtgatatttattttatttattttttgagtcagagtctcgctctgtcacccaggctagagtgtgctgatgtgatcttggctcactacaacctctgcctcctgggttcaagcgattctcgtgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgagattacaggcgtgaggcatggtgtctggccctaatgtgagtgatctttaacaatgaggacttgaaaaagaaaaccatgaagaaacctaattatttgatgtctggacgacaaggaagaagatagaaatggca

SEQ ID NO: 9941 - DNA, 1099 bp, Homo sapiens
tttagaggtttctaatcctgtatcagaagagacatttgatcttttaagctgaaatgctgtggtttgatgttgttttaggtatgaacatgctaatgatgataagagcagtttgaaatcagatcccgaaggggaaaacatccatgctggactcctgaagaagttaaatgaactggaatctgacctaacctttaaaataggtaactgcttactttgtaagtcagctgtggggtttggaaggacacttggtaaccggctttgaagacgacggctcatcccttagcgggctagcgcctctcgggctgggttccaggcgaagatgcggttctgagacctccctccccttctgcagccttgccaggcctttctctccgcccttagaatctccatggaggagacccctttgtgtgtggtcaggaccctgaacaggagagtaggtccacgtctcacccatgacagaggactgagaaactcaagtttgtctcgttacctttgcaggccctgagtataagagcatgaagagctgcctttatgtcggcatggcgagcgacaacgtcgatgctgctgagctcgtggagaccattgcggccacagcccgggagatagaggagaactcgagggtccgtagcacccatcagtgttcattcctcttctgagttttgtcccaccaaacagcaggggccacgaggaaagcagctgcccttgggatgtctgttcgttgtctctcaaagtctgtcaatgtttcctgtaagctgggccttgtgccaggtgtcagagatgccaagtaggtttgacacagcccatgccccagtgatctcacaagctcagggggaaagatccacatagccacgctgtgtagtaaccctgccttagagaagagggcgggtagctggacactcaggcagacacattcacccctgccaccaaggtcagggaggacttctgctctggagctgtgtcctgagggtgaatgaaatgggctgttgtatgtgtggttccccctacaccccttccctatagcacttcccaccaggaatagacctactgctgtgggtcccttagcatggaggaccaggatacaaggctgataaggtatcctcca

SEQ ID NO: 9942 - DNA, 1243 bp, Homo sapiens
tagagaagccaaccttactgtcccctgctgtgataaagatgtcaaagtatctttgttcttggacacaaatatatataataaaatacgttaagaaatgaggtggcctgaattagtaagaaaaaagttgattgcttactgctttacccacacacatttccatctaggacttgacatatccccatttgatatacaagttaaatggggtctgtcaatggcatccaaaaagttactacccgccaaagggaaagcagctatgacctggtctaaaccctttttttcttacagatggggaaaccagggtgcagagatttaagacttacccagcctgtaaactctcacctctagtatttgcttgtcatcttggtgcaaccagaaatccacatgtggaaatggtgtccaggagtacggtcctatacgaagttgttctgtctctgcatcataaatgctaatcatctaaaaaagaacgtgtcaaggatagaatttcaggaatgtcacccacttttcaaaccctcccagtaacgcaagctccagtgtagtcctttcatgcatttatctgcctaagcttcttaaaacctgtctcaaataacaaaagctgccagctactgaacacgtccagtgtgtctgcttctgcacactgtggggcacgcacgactgctgagcgccaacagcagtcccacaggacgagggtgttttttcccatttggggtgaaaacttgaggctcagagaaacaaggcccatttcccaggttacgtgtccagtaagcctcagagctggacctcaaacccaggcgcttctgactaaagtctgtgttcccattgcctcattatttataccccaaacaactgatcaccttgcaatttaaaagcatacagtgcctgctgccccatcaaaagaagaagctaatttgccaaatgatccagtccctgaattcccaaatttgccaatggcagcctcagcttacctagcaatattcactttggtaactgacactgaaatatgttctgaatatcaactaaactaggcctgttacactccttgagaagtcctaaaaatgttaaaagggttggctccgaatccaaacacatttcccagtgaaaacatcagcatttcataaatgagaagatttctttggggtggcctgaatgtgatttccgttttttcacactttgagcatttttaaagaattctttcacccattcctcaaatggcatataaaccttgggttttcagttttctaacttt

SEQ ID NO: 9943 - DNA, 2708 bp, Homo sapiens
tcatgtttcctgtccccattgagcttcaaatctgtttgcaagtcagacttgaaacaaatgattacaatgtgtgatgagcagttatgtgggtatgttggtaagaaggaagtgcttatcagagggagcttttgttctgttctgtttttctagagacatggtctcgctatgttgcccaggctggattcggaactcttgagctcaagcagtcctcccacctccacctcctgagtagctgggactacaggcgtgtgccactacactggctttcttttgaaattaagatattttcttcaccatctttacaaacgttaacaccttcctgaggaaggaattgttgaaagcttttcagtcagcactggtgatgttactgatgatttctgatgtttctgcaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaatttctgttttgtttttttttttttaatttaatgtattaaagcattttgcagtggaaaactcctgaggcattgctgttgaagagggagaaatagtgctggtgtggcggggagcttgatggaattcattgcatgccggggtgaggatggtttccgtgtgcactatatgaagtatccgcgactctccttaatcacacccagcaaagagtgattgaggcttgagcaggtccaagggaagcagacacttctttcaaaaagttacatgctttgaagggacatctatggggaaaaatactgtgaaatctccttataaattacatgccaacaatgggaatttttcctttcactaaaaagctgtcagttgtaggagtctccagggtctgtccttttgtctgtgtgctctggtttggtcttccttgatgagaagtggctgaa

SEQ ID NO: 9944 - DNA, 1372 bp, Homo sapiens
tgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatctattttgagtttcccaagtgagtggttttgtctgtctgtctgtctgtggggaggaattacaaaccaatacagttctgccatctttcattttgggtctcctcaacttctctccccttctggaaatagaattgtgaggtggagagtaaatccgtctacatcttagaggccttttaaactcagcacacgccgaagcaggtggctggatggtgggcccttcgtcgtcaggatcctccaagt

SEQ ID NO: 9945 - DNA, 1197 bp, Homo sapiens
gagatgtatcataagtgctgcagtcgaaatctccacaagtgttgagagtacacagcttcaaatatgcatacatttcaagacttgtgagagaaaagtattcttcagaagttcatttaatcactccatgagccacaacagtagacttaacacaaaggccaacacaggactcagtggcctgcacgtccctgctgatgtggaagcagacgcgtaactgacttggagcccagttgccctatttttaatccccctcctggaaaactacccagaaaatgccatcagaatgcatcagagaggccagtgcctcagtgcttgcctccctgggtccttaattttaaccttcaaacctggtggtgggcattcagacaaatgattaacacatacattaaaccaaagccttctgtttagcaagcgcctccttttctgttattttgatttaacctttcctttttttgttgttttttcctatttcagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactggtaggtgtcaggtattttgtcctggagctaccacctgtccactatgagaccagaggaggctattggcttttattttaaacagcagcacaatttgccaagtgtgaaaacaccatggatgtgtcctttgatcttttgaaaattcctaaaatgcttgaggggttggcgttactggactttgttttattttttatttatttattttttttgagacggagtcttgctctgtcgcctagctggagtgcagtggtgcgatctcggctcactgcaacctctgcctcccgggttcaagtgattctcctgcctcagcctcccgagtagctgggactacaggcaccagccaccacgcccagctaattttttgtatttttagtagagacagggtttcaccatattggccaggatggtcttgatctcttgacctcattatccacttgcctccgcctcccaaagtgctgggattacaggcctgagccacagcaaccggcctagactttgttttttagatagggccttgctgtgttgtccaggctgctcttgaactcctgagctg

SEQ ID NO: 9946 - DNA, 1135 bp, Homo sapiens
gttaccactaaaaatgccagtaagtgggtttgcgttatttttgccattttccaatattacattgtggaggctgaaagacagcccataataagggggttgccaggcccagatggggctgttctttgtaagaggtgggttagattttgaagtaaggcttagaaaccttcggttcttctcacaaatatacagataattggtatgtatgaagtttgcttttatttatttcaaaatatcatatgaaattgacttgtagatttaccttcccaacttgccagtgtcttcaaagctagcagtgttttgtgtcaggtggatagaaataacggattaaaagtcatgattctttttgcttccaagtattatgggtagagaatatggcgagggttctcacatacttgtgtggttggcaccaaataagtggagtcaattgtgcatttttttcggtatttaatccttaagcttcagcgggcctctgagtctgtgctttctattgtgcattccctgtggtgcatggacacaattagcaggagtggttattgctccacctgtgtgtagcctgtttatgccatatactgggaggagggtgtgagcacatttccaggactagcatttctgatagacttgacttgggataagaatgtttattgcagtgctgggctgtgtttaagccgctggcgaatatgtgtgtaactctgaaagaattaatgataatggagaaggagccatggtgtgggtgatccaggagagtgggcaatcccatacgttaaatgaaagtcttcacatataatttaataactgagagttacagaagtacgttagacatgatctcatgcaaagtcttcatttaagggagaaagaaatcagctcttagaaaaagtaaacgtgtcattggtgattgcagcagttaagagagtgggccccgggtatcctgattccggcacttgcctgctagtcacctgtgtccccgatacccaacaagccccctgcggtctggcttaagttgaaactcatgctatggacagttgagagttgtggataccagaggcttacccagggagtaagcatatacaggccttaccttaatcttttgaggctctttcctaactcacctttgtcattatttgtttttagtcacttg

SEQ ID NO: 9947 - DNA, 1166 bp, Homo sapiens
tttttctttctttattttattattattattttgtttgttaagatttgaattgttggccgggcgcagtggctaatgcctgtaatcccagcactttgggaggccgaggagggtggatcacttgaggtcaggagttcaagaccagcctggccaacttggtgaaaccccatctctactaaaaatataaaaattagccaggcatagtgacaggctcctgtagtcccagctactctggaggctgaggcagaaaaatcgcttgaacccgggagacggaggttgcagtgagctgagatcgtaccactgcatgccagcctgggcgacagagcgagacttcctcttgaaacaaagatttgaattgttgagagccataggactgtaaatatagctgtggtttcacattttagtatgttgtaaaatttgtacttatgcaaggaaataacactgaaatcttactcattcttaacagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacggtaactatatgcaagactaaggatgtagcagattcctcatccaaatagatgagagaggtccatttggtctgggatacagtctctcatcctagagtctgtgccacatttttctgtagatcttgcctgtattgcctcttataccacattataatgtgagagcacagcacaattttttaactcttctatttcactttgagtaacagtagatgccttgaatatttaatgttaaaatttgggaaagatttcttcctcattaaagtcacaggtaacaaagattaaaaatccacattgtggagtaaaatcagaggaaaatacaaaatatgttgtattttactgtagccctcttgagttttgagtctataatctaggaagggttgggaagagcttatccactgcctgttttttatttcgagatttctcttgaatatttacttctcagtatacatttatgtctctaacttcttgcttactcattgtgattttgacattttcttttttttt

SEQ ID NO: 9948 - DNA, 1177 bp, Homo sapiens
cctagaggtgaaaggcttcagagaggcagtacagggtagaggttagcactttgcagcccagatggcctgggtttgaatcccagttctgccccttgctagccatgtgaccttggggaggagattaactagcttctttgtgccttagtctacccatcacatataggaatgagcacctcaggttttttgtgaggattgaatgaactgatgtttgtaaaactgcttagaacgatgcctggggctgtgggctttgtataagcgtgagctattattgtcactgtccttgtcattggtggtgctattcctgtggttcaccaggtgagtgggcacccctgtgagggcagcccggctctaacattttgcctcctggaggtatcggttacgtctagatgttctccagcacagccctgccctgggaggatggcaggagggaaccttcatcaactccccgcgtctgttctctaccccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtgggcatggtgggcctgcaggagcgggtggaggaggccgccttagcaccttgtctctttgcctcgatcttttcctcgcaccttgagctgggtataaagccaaaccccggccttgcagaaaggatggagaggcttgatgagcgcggaggacagatgaatcattaagagcagacagcggcactgtagacatgcagtgcccgcggcatttaagtgcagggacacagctcttctggagtcagaaagccctgcaagtgcttcccgttaactgtcatcctagtgatgcaagactgccagcgaccgactctgctattgagtatcttcataccgctgttcccgtctgggggtgatcatgcacccctgggtgatgtgtgtcagaagcaatttactaatactaagctaaaccatatgagattgtcatcttgtgggccagatgtcatggctcacgcctgtaatcccagtactttgggaggctgaggcaggaggatccattagattccaggccagcctggg

SEQ ID NO: 9949 - DNA, 1242 bp, Homo sapiens
ctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaatggttccctttcctttggggcctcggcgagggttccagccatgtcctctgcagggtcaggatgtggcatcttcctgtttctgttctttccttttgacaacaagtcgcctctagtgggagctgttgccagaaagggcaagttgtagagatcactagtcagatggggtttagtgggaaggcgggacagccgcaaggtggacggagcccaggttttggggttggacagaccctggcttgagtcctgctcttgtcatttgctgttcttgtgaccctggggaagtcactcagcctctgtgcctcacttgctttgtctgtaaaatgaggctgatcgtacttaccctgtgagcagtgatg

SEQ ID NO: 9950 - DNA, 1275 bp, Homo sapiens
cagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcaggaggctgaggtgggaggatcacttgagcctgggaggttgaggcctcgatgagccatgatcatgcccctgcactccagcttgggtaacagagtgagaccctttctccagaagaaacaaaacaaaacaaaacaaaacaaaacaaaacaatccatggggtggcaaaagaaggcatgtccatacaacctgtgctccaggtcgcaggttgcagggcagatatttaaagggctcctggcat

SEQ ID NO: 9951 - DNA, 1185 bp, Homo sapiens
ttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatcatagatgtatttcttggatgacatgcacgtaacccccgggagtcttcagttgagccaaatgtagagcaagtcagagtcctgagtgaagctggctggggcaggaaaaacacgagctcagccaacatggtccccagcagcttttggcgtcagtgatagagaaatcggagatagtggaggttgtggcaagttgaagtgtgcccaccacgtctaagggaagcttagggactcagctctggctcacccctgctgtgcagaaatgtgcgttcatttttctagagaagccagaaaaacaaagatttacgtgaaattt

SEQ ID NO: 9952 - DNA, 1212 bp, Homo sapiens
aaaaaaacaaaaaacaaaaacaaaaatcagccggtcgtggtggcaggcgcctgtagtcccagctctttggaggctgaggcagggagaattgtttgaacccagcaggtggaggttgcagtgagccgagatcggccactgcactccagcctgggcgacagtgcaagactccatctcaaaaaaaaaaaaaagaaagaaaggactcttgagatcttctcagagctctttgagaggaaagattggattattgcacttctttggcacaaagtagtctttgggaatgggaagcagtgaaggaagggtcaaggggaaaatagtttctttcagaattgcaaggtggattgttttgggtattgtctcccaattcttatatgttaggttgtaaaaattagttctgatacagagcaactgtcttccccccaactttttggagaagcagtcactgaggtgatgggagagtgaagaattgagtaggctagagcacagaggtttagctctcaagttgatgtcttttatttaatccagtcagttatcttttgtaggttacattggcgaatttgaaatcattgatgaccacagagctgggaaaattgttgtgaacctcacaggcaggctaaacaaggtaagaacgagtgatctacacatttcaaagctttaagaattttttactgtggcgttaaatgttgtaattgcctttggaaatactgagtagtggtgccatacttgatttatccagttactttaaaaaggtttaaaaattgacacatggaacttcatttgctctcctgggttgattgtgctaggattatgtcagttgacctagtgtttttatggggtataagctgtctcaggagagatggggggtgaaaccaacgctggtactggtatttggatgttaacgctacccacctcactggcttgaacttgggtggctcaaggccattgagccttttgtccaaggtgctgtgtccttcctctcagtgatgtgttgggttttttgaatggaatctttatctttgagtaaatggggctttctaaatagcaatatgaatactttttctgtttttgctggcataggtctttggggtctatgctgcttttcagtttgacttgtcaacaccttaaccaagtaaaactgactttgtggtttaagtgattgcgtgtgttttgggggcaggtgtcttaagctggttgaggtgtccactgtgcttcctg

SEQ ID NO: 9953 - DNA, 2182 bp, Homo sapiens
aatcccagctacttgggtagctgaggcaggagaatcgcttgaacctgggaggcggaggttgcggtgagccaagattgcgccattgcactccagcctgggcaacaaaagtgaaactttgtctcaaaaaaaaaaaaaaaaagtaataacctttagcaggttaattgctgcctccttaatgttgggtttttttttattttaagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttcatgtctcactttctttataacttagccaatataatatttatgattggatttatgaatctgattaatgaagtaccctgtgtggtccttagatgtctataaggtaccctacctgtaatcccaccactttgggagacctgggcaggaggttcactggagtccatgagtttgaggttgcattgagctgagtgtacccctgcactctagcctgggcaacagagcaggaccctgtctaggaaaaattttaaaaaagaacaaaaataaaaggtttaagttttattt

SEQ ID NO: 9954 - DNA, 2581 bp, Homo sapiens
ctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgcttttttggtactttaacaagtattgtaggcacggtggatttttttgaaatacccatgtgtccaatagcaagttaaggaacctagcgcatcaaattttgttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccac

SEQ ID NO: 9955 - DNA, 1262 bp, Homo sapiens
atatgtgtatatatatgtatatatatgtgtgtgtatatatatgtatatatatataaaatagttcacaaagattaacacgtggatacccaaaatatcatattaccattgtatattttggtaaattaatgtttatatttcacttttattgaatttaataaattcctgacctcaactgatccgcccacttcagcctccccaaagtgctgggattacaggcgtgagccatcatgcctggctgttatttatggtttttgatgccacaagcctagtaaacataattgtacaaattcatacctgaatgtctggctgtttttaggctacatttttaggaagacaattgctgtgtccaaggataaggatttatagttgattatttaattggggtatcaaccactaccacctatcccgtgcttgctccactctgccccctccatgttctgtttacatgtaaattgagccaccaactctttctctgtagcagtccggagtaacactggccagaagactcagcctgatgtcatgtcacagaatgctagaaagctgatccaaaaaaatcttgctacatcagctgatactccaccaagcaccgttccaggaactggcaagagtgttgcttgtagtcctaaaaaggcagtcagagaccctaaaactgggaaaggtaattagttagaataaagatgccttaaatttttatataaaatgacggtttgacttacgtatgtttttgttgcttcatagcggtgcaagagagaaactcctatgcagtgagtgtgtggaagagagtgaaagccaagttagagggccgagatgttgatccgaataggaggatgtcagttgctgaacaggtgaccgtgttttaaacttgggctacacattttaatgctgctggaaaagtagaggtgtataaagatccctctcatcgatttccttaatagttcatcaaggaacttaaatgtgttttcaggattcagaagattttgagtaacacagctctggcgtcgtcaagtagtcaccattttactctgacccttccctatgagcactttcctttcccctagccctgttttaacccaaatataagtccgatcctcctccaccagactacagttagtttccatttaaagaagactgttgaaggtttcaaatgaaatgccaaggaccctttgggttgcaggtgtagtatgagtggagcatccctaattagaaactcatatgctccaaatccgaagcattttgagagttgacatgatgccataagtgaa

SEQ ID NO: 9956 - DNA, 1152 bp, Homo sapiens
ttccttcatgagaatggagaagaaggatctttgagtctagcaagtgttattatttctgccctttgtacccttacaaggtaagttagccaacttcatattggaccatttcctgtgtcttatttttaatcccaaacctaaaatgttcttttactttccttagtcttgccaagtgttacagctgcttacttgcttttcagattttagttatcttggttgtgttttgagacagggtctcactcttgacactgaggctggagtgcagtggcacgatctcggctcacagcaacctcagcctccttaatagctgggactacaggtgtgtgccaccacacctggctaatttttgtattttttggtagagatggggttttgccatattgatcaggctggtctcgaactcctggcctgaagtcatctacctgcctcggcctcccaaaatgctggaattacaggcatggccttgacccggccagttaccttgttttgtttatacatttaagtttcactgtacagatatttatctcttgtaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggtgaacacttttattttaaatattagtttgttttagatactgaatattgtctttctcatctctttaacccaggaaagcaatttgacttccccatttgaatgttgctcaaccagtcatttaaaaggaagataattgtgagatttatagctataacttggttacagttgctctttgtttttttgaatttttatagcagctttatttgtaatagtcaaaaactggaatcaagtcaagtgttcatcaagcaaatggacaaatatggtacatccacataatggaatacttcttagcaataaaagtgaacgacaccttgataacatacagccacatgtatgacttacaataattatgctgagtaaagaaagctagacatttctacccctataa

SEQ ID NO: 9957 - DNA, 1147 bp, Homo sapiens
atgttggagggaaatttcttaatggtgtttcacttgctgcccccatttcctttcctttagtcttatgcaagatctactgcagtcatgtctatggttggatacataattggccttggagacagacatctggataatgttcttatagatatgacgactggagaagttgttcacatagattacaatgtttgctttgaaaaaggtaatataaaagtagactttacatttatgagggccaaatgttttttggtgaaagggcaaaaatataatgatttgtcttttcaaggtaaaagccttagagttcctgagaaagtaccttttcgaatgacacaaaacattgaaacagcactgggtgtaactggagtagaaggtgtatttaggctttcatgtgagcaggtatgctgttttctcttctcccttttagtgtatttgttaaatgagcaaaacctgtggaatgaaaaccacactttagtgatgaaacttgtggcagaccttattttaaaaactctcctgaaaacaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaagcccagtgacggaataagtcattgtcttctttttattaatagagtaaacatgctcatcaaaatgttgaggcaaattgtttctctaatttttttggcaaaactaatgtataatattgaaatggcagttaaatatggcagtttgatgttaactttttattaggtaattcttccacacaaacatgcacagttacattccacactcctaagaggtgggttcatgatttgaaaaaattatatttcttaattattgaaatgtgtttaccagtgatgactgtaaatgttctttaattggatagcttcccttccctatctggtagccagggatgccagtcttgttctgggtgacattggcaactattaatacatggtattatgagattgagcctgtcagtttatgcctgtgtaa

SEQ ID NO: 9958 - DNA, 1149 bp, Homo sapiens
tatttttcatataagcagatgaaagagaagaagtctttgaaaaaagagaagtaggtgaaaaagggagagacggagggatgccagcagtgaaagaagccaggactgagatacaagattgtgatgctgggagagctgtgcaagggctcatgctgtaggtgaggagtgaggctgcacagggagctcactggcagcttggagagaactgggtgtcaaagttgtcctgcagaggtctactgtcagtgtgttaggatctgaagagaacaggctgcaacacatgaaaacaggaaggagacacaggggcgagtcagctccactgaaagtctgtagctgtgactttctggtttgccactccaatttgagtactaattaagtggtagtcacatcttcaacataaaaaccaaaataatggcatcctcgtggaaggaattttgtcagaaaaatgctgtgtactttgctgtcttcctaggatttgttctgtttttgtttgtttttttttaatggttccacaggctgcataggaatacaagctaaccaatattttaattacagatcattaagcagctttgagtctggaaaatttgttgaatgtaccgagcagttagaattgttaccaggagaaaatatcaatctacttgctggaggatcaaaagaaaaaataggtatttgagaaaatagttttaaagttattttagtggacaagttgctcaaaatgtttggcttagtatattttactggaaaatctggaagttattttacatttttgtgggggcagaatcccatgtgaagcaacaaatttagggctgccctatttatgtttgatttgggaaatgaaaagcacttaaaattaagtcaaataaaaaaaatgaccaccttaatactttgagatttatctagccattttgtttgataaaggacaaagtagtgtttcagctaaatatttttcttgattttcatcttgatgtggctcattaatttatcacaaatagaacactttataaaatgttattaaaaagtttaatgagtattctggattgagcaagatttgctaatgcaggtctagatttgtccccttaaatagtagattgacttaccgattttcttttttgttgagacagagtttcactctgttgcccaggctggagtgcagtg

SEQ ID NO: 9959 - DNA, 1193 bp, Homo sapiens
acgcaatctcctgaagacagatgctgtcctttggcagtgggccatatgggaagctgcacaattcactgttctttctaagctgagaaccccactgggcagagctcaagacaccttccagacaattgaaggtaactcactcaagctttgtgatgtgaatactttcaaagccttattaagaaatactggattcttaaatctttgttaaagatttgagagtatatgatttttttgaaaaaagtcaataattttcaggtatgtttgttagaataagctttcattgaataattgcattggaaatatgtttttttttccccaaaacttagggagttgtgtggaaaaaatatatatttctttcccctaaaatgaaagatctttcatgttgggattttttatttttaaatgatgggtagacagaggatacttgataaatgtgaattggtcataaaaaactcacacttattctaggaacttttaagatttttaaaaattcagaatgttgtctttgctttcaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggttggtttccatgagatagtgttgttttatagcagtttaatggtcacagctggcagtatgtgcagagctgaaatcacagtagacttgtgtatttggtttatatataggtgagacatccttacctacaaattgaaccagtcctgagcttttctttctcttatcgtaaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggtaatgtggtgtgtttgaaattcattttaagtctgttaataagaaaagcatggtttaattcctttggtatgatttaatctatggataaaataagttaaagcttggattcattttcaaaggttttgatcctgtattttgtaaaagcaacaac

SEQ ID NO: 9960 - DNA, 1178 bp, Homo sapiens
aaatttattataaatttaaattttcataagggtaaaacaagttgacacatttataacgttataaattaagaagtactgtatattttgtaaacaaaaatgactggcttttcaaccaccccctagtcaaatccaccacagactttcctggtagatttaagaaacccagtcttaaactgctgtttgcatatgtcttctgatgttgattatttaaaaaaaaaaaaaaacggccatttcggaaatttcatattgacagttttcatttatagtactctgtatttgtgataaaactttatagacttgaaatagcatactgatctgtgtcagttttctgactggtttttaaaaagttaaaatattaagtgctacggacagtgaattgatcgatcttaaatttatttgtatcgtcagcactaatacagatagtgatttattttccatataattttagaagatttattttccatttatcacttccttgaattttttgtttttcaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaataggggtgagtctttaattgtaatgactttgttttatccacagttaagccttttctcattacatatttatgtatttcactgtcatgtcaagatgtctgcagaatcactgtgtgtaacaaacagccatatttaagacatgcctggataaataaaattggtaggaatgttttcttggcattatatttaacttttcttcttctttttccttgacaaatcttgataagtttttttatattagttttattttctagaaaatgtcttatgaatttctcctatttgctctagcatgcttatagaaaatgtcagtgtttcttacagctcaaatttgtgtagttgttttaaaatgcggtctctttcttcttcccctggtacttttttctttctgtctactgaagttagttcttatacatggtcttat

SEQ ID NO: 9961 - DNA, 1314 bp, Homo sapiens
ttagaaatttagtacacaattattggccattatagttaagtgggggattttgtttgtgtgtgtattggaaataatatgatttttgaaggtattttgtggtaagcatgagagtgcttatctttcaaaagagaccatcagtagatagaaactttaataagcttaaagtgacttgtctgtttagttttaaaagattgattcccaaaagcccaagagctagcttgtagtatgtgtgggcaggctattcccatgctgtcaataccattactgttgtggtggtgtatttcatgataaagattctgagcttccgccatttagtgacattgggagaaacgaagttgggtatatgggaaatagaggatggcagattccatttcctgtcataatagcactttaggattttttagccaagatcatgtttacatactgtactaaagatatcattattattcaactactgagaactagaatattaagagactgctggcaaggcaagcagttaattttcagttgaaattgcattaaataaaaagtattttcttgctttgtggaagcacgtgaatttttttaaaaagctgcttgttttccccatttacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctggtatgtgaattattcttttcctttttaatgtgttggtttattcaggcccttaaatcgatatgtaagaaattaagggctttgtctgggcatggtggctcatgcttgtaatcccagcactttgggaggccaaagcagaaggattgcttgcatccaggaattctggcacagcttgggcaatgtagtgagaccccatctgtacaaaaagtcaaaaattagcttggtgtagtggcgtgcacctgtagtcctagctactcgggaggctgagggaggaggatcgattaagcccaggaacttgaggttgaagagagctctgattgtgccactgcactcagccaaggtgacaaaaaaaggccctgtctccaaaaaagaaaaaaaaataagggctttgctttattatattattttcttagagtacattcatcagttataatctgtgctttcattttagtgtctatttacttttatttttaatgcaatttttttttgagacaggg

SEQ ID NO: 9962 - DNA, 1228 bp, Homo sapiens
ttttgaacctacctgtctcaccttcctgccttcttatacccccaactttcttgctttcttctaatatatttaaaatatgaataacaaatgcagtgttatttctgaaaacctcataggacatttatccactttattatttttaaaatttaaaattttttccatacataattcataaatgcagttttcttacaaggaagatacaatactatttttgtttttattttcaaaaatatttagctaaggttgaagttcctcttggctactatctctaaacttcaagaaagttttaaaacaaggtacaaaatttgatttaatttagttttcatttctttgcttattttccaatgaagggatcaaaataaaattaatttaacttcaaaggtgtattaaaagaaatcaaaatgattttcaaggcagacagtacaggaaaaaggtaggagaagcaaaggctggttgagctgcagattgagtaataagatcctgagctatcaggaaattgactgaatgaaacgaacaatcatatttaaataacgtacacattgctgtttgtaggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacagggtaaggctgggaaaacggggaccaatcacatacaccttccaaagacttgtatctcctcttattctggatgcctcttactaacgccttgcacaggcataagttgattagcctactgtgcaggtaaaaattgtttacattcatttcccactagaaaggttatagtacattttaaaagagaagcctcttaaaacaagattagaagactggataagatcttacagaaaaggtttacccaattatcgtggatattgaatgtatagtgcatagtaggctcttactacagcaagtccttgaactcttgggcctgtggaggatatagatatatatagagagggggtacttttctgtcttttttttttttctcttttaagttcagggtacgtgtgcaggatgtacaggtttgttatgtaggtaaacgtgtgccatggtagttggctgcacagatcatcccatcatctaggtattaaacccaccatccattaagctattcttgctgatgctctccttccccctgccccct

SEQ ID NO: 9963 - DNA, 1123 bp, Homo sapiens
caatagtgttaataatgataataatggtgttagtaataatagcagataataatgccatgtgtccccactctgccattactttacacaaattatcatgcactgattacacccaccctttgacaaagtactagattatattttagttaagaaatttttttttgagacagggcctcactccaagttggagtgccgtggcgtgatctcagctcactgcagcctctgcctccagggttcaagcgattcttgtgcctcagcctcttgagcagctgggattacaggcatgcgccaccgtgccaagctaatttttgtatttttagtagagacagcgtttcaccatgttggccaggctggtctccaactcctggcctcaagtgatctgcctgccttggcctcccaaagtgctgggattacaggtgtgagccactgcgcccggccaaagtgtcatattttataaattaggaagctgaagttcagagaaactggtccaaggtcacacagcttttaagtgaccccttggatttgaacccaggtttatttcactccagagcctaagctcttaacccagtaagcaaggccctgaattgggccaaccgttctacctggatgttttggcttttgaagaatgttctgatgctttcacttgaaaacacaggttggccgaaatcatcaaaggagagatggacgtgagaaagctcacaggaacttttttttccctttccaggaaatactgattagcccgtggcttcgcagtgtgtagcatagtacagacactgtggggtgatgggttgggtcatggtgggtacctggcctcacttccgtcactcacaccaggcatgtcccgccggctgccccgaggctgggcaccaagtatcttcggtactcagtgtcctctggctcacaagatgttccggctcctcctgaattcagaagaacttatgtccctgcgcagtaacacagctttttaaactattgagaaatttcatgcctgttaccattatatcctttcttactccccatttgatatttccttcaagtctttcttccctcaatggaaatacttatttttaacatgtaggagaaaatatatgtgcttgtaaaaaacttcaaataaaggaactcctaa

SEQ ID NO: 9964 - DNA, 1194 bp, Homo sapiens
agctatccccccacctcagcctcccgagtagctgggactacaggtgtgctccaccagacccggctaatttttaaaattatttgtagaggcggggtctcgctatgttgcccaggcttactattttaaagtagatgtaggatacaaataaaaaaaaaaatctccttccacgtaggtaaagcaggaaataccgtgccttgttaataagtaattccctcatgatccttttccccaggaacttgggtgagaaatcataaccttgtcctgatctttctaaacagcaatttagcattttcatctccctggcaacccaaggcgccttggccttggtcttccgagtgattgacagtgaccccacccaataaaatctttttatttgtcgtatctaaccaatctaacccctagcgcagagctagggggcgttcccaccggtgcgcgggcgagctgagccttccttacgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcaggtaaaaggaggcgcgcagtcacagtcctgcgccggtctagcgagctagggaattttcgcttgaggtttgggtcgaagaggtcacgggggagaggttcgtaacgtcacaggcctgcgacggagcgcgactgcgtgacttcggcctccggggcgctggcgggcggggcggggtctgtagttagcggcgagagtgacaggaggacaggggttgtttcggcagtgacgcctggggagtgacgcaattgcacccctgtgcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatgcactgtaaactgtgaaagccatcagtgtagtggaaggagcatcgaatttagagtagagagacatggttttggaccc

SEQ ID NO: 9965 - DNA, 1150 bp, Homo sapiens
ttcaattaatttaaaattaatcagcacagaaaagaaagggggaatgtggtgtgagatgaagccaaggagacaggtcggggccaggtcaggcacaccttcagtggctgtgccaaggacatttgggggtggcgatcattagtgagctactgaaatgttttaagctgggacagtgtagaggaggttcatggcatcctgggttttggaacagtccctctgatcacagtgcagaggccagttaggaggcattctctgggcaccattggtatgcagtgaacaccatacttagtggccattatggattcctgagacagctgcttattattctaacaggattggctttcctctttccccagggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacagtttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgc

SEQ ID NO: 9966 - DNA, 1270 bp, Homo sapiens
gtcttcgctccgccgccttctggagtcctttctgcccctagaggacgcaggtgagctaagcagcagtcatgccctttaccatcatgacgcccgcaggcgggaccacccggcactgtagacagctgccctttacaatcatgactcatagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggcggggtaaggatgggaagccgagcagacggccccagaacaagcggtcatgtgactgggaagatggccgtctttccttggtaaggaagcagcggcgggtgggctttggagaggggctgtccttacttgtgatggggtcggcctgggtctgagagtgtgaattcctctctgtcgggttctggtggtcgaccggccacccccaagttgtcttgaccgtagaatccctggccgctaccgcggtccagcggagcaatctgaagccagactggcgggttcttggttctctccccgtctgctgcctctctgcgccttccacgggcccctgtccattcattccctaaagaaaacttgagtttccaggcttccgcgtccccagaagttggcgcgggttctggggtcgctggatgagggtaatggtggactcagcttttaaagtctggacgagtcgggagatctggctgttggtcagtttcctcagctcctctgttcacctggagacttgcttttctcatctgtaaaatggccgccattcatcctatcctaggcacagccctcagacttattccttggcctcaaggagctgacagtataatggggcagacgcacagtagagggatgtctaaagaaggcattcggatgaggcaccaagaagggagtgattatccccaccagggggctaggggaaggcttcagagaggaggagttaaattgggtcttggaggatgaataggagtccaccatagggagggcgtggcgtgtgcctggttggcaggcccgtaggtcccttgtggttggagtagctaggaatgagtgactgaagcttcagggttcagcaggtggtatgtgtgtgagtgaagaacttgaggaagttgtg

SEQ ID NO: 9967 - DNA, 1201 bp, Homo sapiens
gagaccagcttggccagcatggtgaaaccccatctctattaaaaataaaagaataaattaaaaaaatagccaggcgtgctggcaggtgcctataattccagctactcaagaggctgaggcaggaggactgcttgagccttgaggcggaggttgcagtcagccaagatcgtgccactgcactccagcctgggtgacagagagagactccgtctcaaaaaaaaaaaaagaaaagaaaagaaaaatcatgtcttcacatactggttgtgggggactctgcaataaggcagtgaaagccctagcccagtgcctggcagctgctgtgatgatgattattattattaatgtcacccccgctccccgccacgcacacatgggctagaggggtgacttccacacccctggcttagactgtcctgcaggctgggtgttttctttgtgattcccaaggccccaagcccagtgggaaatttccgccacttccatgtgccctgccacgacttcctgccatctgctgactcggtgtgacatgacacacggctgcctctccctggccagcatggccgcggggcttgggtctgtctcactgttcttgtttgttcaacagtggactccaacgacagcctctacgggggagactccaagttcctggcagaaaacaacaagctgtgtgagacggtgatggctcagatcctagagcatctgaaaaccctggccaaggacgaggtgggtgccctctgctgtcctccacccgccccttgctctgaaagcacaagtttccagggtggttcaaccttggttcattctagaaaggaaactatgtcatgtgagtaatgtgtttatgtgcaaaccacttctccattgctttggggccttcgctcctgctgttttctctgcctggactgcgcctcccccagggcttcccctggctgttccttctcgtcattgaaatctcagctcaaaggacctcctcaggccttcccggaccctgtctgaaggagccaccaccacctgcatgcctctgcccgattgtccctgtagcgcctgttcagtcaccgtctgaaatgttctgtctgtccatccctcagctccctgactagaatgtaagctccatgggagcagggacctggtgagtctttttttttttttgagacagtctcacactattgcctgggctggagtgcagtggcataatctcggctca

SEQ ID NO: 9968 - DNA, 1185 bp, Homo sapiens
agcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtaagtctcatgtggaagttgccatggttttgtttttctttctttttttttttttgagacagtctcactctcactccacgcccaggctggagtgcagaggcgtgatctcagctcactgcaacctccacctccagggttcaagcgattctcctgcctcagcctcctgagaagctgggattacaggtgagcaccaccacacccagctaatttttttttgtatttttagtagagatggagtttcaccatgttggccaggatggtcttgatctcttggcctcatgatccacctacctcagcctcccaaagtgttggtattacaggcatgagccaccgcacccaggccccatcatttttattttctacaattctggctgacatcttattgctccatccttgctaatgatagacttcatctcacatagaccagtgttttcagagaccggcttattgattcagtaaagggctgggggaaactgcacacacaaggacatataaaatctaagcctctgcctgggccacatgacaggattcagaagcacctttgatataatgggtgcccgacctcatgtgaaagtccaagttcaggtgtaatgtgagagcggtaagaattcactggcctaggcttgggaactaatgctgcccaccacgttcagcctcagaggagaagaaatgacttgaagaacataatttgtgaatttgccaattgtttttcattttatagcatcacacagtaaaagtagataaaataattttaatgaaaatacttctgtgggccaggtgcggtggcttacgcctgtaatcccagcactttgggaggccgaggcggcggatcacctgaggtcaggagttctagaccagcctgaccaacatggagaaaccccatctctactaaaaatacaaaattagctgggtgtggtggcgcactcctgttatcccagctactcaggaggctgaggcaggagaattgcttagactcgggaggcggaggttggggtgagccgagatcacgccattgtactccagcctgggcaacaagagtga

SEQ ID NO: 9969 - DNA, 1295 bp, Homo sapiens
gagccatgggaagcctcatttaatgagacctttttccccccttttaaatctgatatgttatcgcacttagggttttgttttattttggcttttaaggttgagagtgggctgaacgccttcataatgggggcggaggcgggagtgagaggagaagggagagagctgttctttttctaatgactacacctgaaaagtatcaagagacatctttgccaagagactgtagcagccagctgccccccgtggagcaaggtttaaagacaaaattaaatggcacctctgtttaagatctgcgtgtgtaaacaagactcgtttggggaaaacgacccgggaggagagcatctgtgatcaaaatctctcattgtaagcacaaattgttccgtgtctggttattaaaatcgctttgggtctataacagccactcttgtccccccttttaatagaaaattgtcattctagcctggatttctccccactggaggtggagggtgggaagagaagggagtcagctctgacagcttacaaactgggaagttctgtgcatctccagggattccagagttgaagatctggttgttggaagctgggcgcccagtgcttttttttttttttttttttagcccagatgccgtcaggacccactgaacaagggtgaactcgggtggtggtctcggttggccaaggctgagttgaacgcctcaggccaaaccccaagttgaaagggagcattgtggcttttataatccaatgatgcaatgatgataccagcttacaggagttctcagcaggtgctttttattaactgatgaagagctaaggctcacttttgatagataatatatatttattaaatgcattaatgtgtgttttataatgtacctttatcttcccccggctgactgttgcatacttataaaaaagaagttaaagaaatttcaagacaatcaatatgtaccataaacgactatataaatattacaaatttaaaaggctgtaaaccatgggcagataggttttattttcaaaatgctgttcttaacacaaaaataaaggctttactatttacttaagacgtgtggtagcttgtcaaaacaacccagtgcaactaactactaggctttcggatctgccttgagggtcggtctgtggcattttaaatgggagaatcttggttaacagcaaaccacagaacatattaaggtaataagtttacccataaaagcaggaactttctatataatactttgggacttagacaacaaaaatcctttgttacatctgtctgggtttaagtg

SEQ ID NO: 9970 - DNA, 1249 bp, Homo sapiens
tagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaaattgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgggattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaattggtgttctaatattttttctttctttctgactcttagtaaatctcttgctttatagtatatatatat

SEQ ID NO: 9971 - DNA, 1188 bp, Homo sapiens
tattttgtttttggtttttctccccaaatattttcaatatgtgcctggcagaatcagaggctgcagaacctgtggatacagagggggccgagtgtatcttttcaggcttattgactttctggatgtgacatatcttaaatcatattgtctactctgatctctgcaagttgctttattcaccagttctgtcagccatactgcttaatgcatttctaaatattgacctctttgtgctttggcttacttgcaagatagaagtcggctcaaaacggggtaaatggtgtgtgaatacacatgctccctggatccacggagaaaaaacactactccatgcagactttgcccagcccgtatctgaggtattccacatcacatctgagggtgtcaaatctagccagaacctgggaaaacaaagagtagccctgatgtacataggaaaataaatataaaagaccagtacataagtcatcatctttgcagttttgacacttcaagctgcacttttgtgaaagtataccttccatttacagataatcctaaaccaaaactgctgtgggtgtgtgcagtcattttcggatatccacttgttccactggtaaagaatatggccatgatctcattgtgttttgtcttcacacaggtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatgataaagaaggattgaagcatttttaaaacttgagatttttatcatacctccagcagagtaaggagtctgtgtgatcttgcaatcatggataaggaagaattttccccttccctcccctatggatgctttaaaatgtgattttttaaaaatgagtatgttaatacaatacatgttagtaaaagccatgggtactgatgggccaacacactacagcctactggcaaaatctgacttgcctcttgtttctgtaaataaaatgttattgcccattcattgagg

SEQ ID NO: 9972 - DNA, 5023 bp, Homo sapiens
attacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcatgttgtaagtggaaatacttttttttgtttgtttgtttcatttgccttggagccaaagtttctgttcctggtggtcgggaaactgcctgccggccaactgacttgaaggaaaactgtggtatggagctctgcttgaatttttttttttttaatatttttatttttttctttgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccaggctgccacaggggcctgaggagctcactctgggcctacctggtttcagttagagggtcctcctgttatttttccatttaaaaagtatgtcctcagaaaactgtactggaaggatgggtggcaggaacttgtatagttcagcttccaacactttggaacagattaaaaagggaatcttttaaataaaaacgtataaaaatatttatactcttgaggtaatgagactttgtctgttaaacatttggaggtttctcccttaacctaataccccgctgcgtcccaggtatgtttctcagcctgggcaggaattgcatgttttgagttccattgtgagcagccttacagctctgggctcccatcttaaggattattaaagagttttggcagttggtatttttctaaaactgatattgaccatagggaacatacttggaatttgtttttttttttaaatcctaaacctgacagttcctccttcagaggggcaaatgggaaactttaagatcacccacggtatagtactgctagaaagctgaagggggtcttgggccagatgcctggcttctgttctagctaaataagactcttgaataagtctccaggggtcccagcaggttctgtgggatcagttgtagctgggtacccagactgaggttttaaaaagactgctttttcattaagccagtttgcaactcattttccccggttctggattgggtagtggttgactgagggaaaagccaggctgctcttggccagataaggccctttccatcccagatcagagtgtatcagagaaagctgcacaaaagaggcaggcagcccaggaccctgagtactctggagaaactaggttccttccccaccctttaagaagacattccgtgcattagatgtactagagtggatgtattttgttgttttttaaattaactatttagcctcctcatcccccaccaaaaaagccatttagttattttttggttatattgatccatttgcaaatgagaagccagaaaagggagcagtcagggagggacttacaagttcctttcaagtttgagtacttgatgctcagcaaagatttcaagcttctgcagtagctctgggccaatgcttgactctttcatgaccacaagaaatgcagtttttctgcaaagggatccaaggtgaggtgtgtgtagggtttgaagttatacttctgggaagtgaaaagtcttgttcctttcaacctagaaataggtttgccacttaatgagtgagcagtaagtctgtgtaagaggctgaatgcatgcccctcagataagccagtacactccttgcttagcaacagaacatcagggtgatgtggagaggggcaggatgtggacgccactttggaaatcggcaacatctgagggcaacaacaaacaagtgtgttgggaaataagaaataactcagttttgacaactggctttgtcagcttttgtgatgtttctttagcagtttattggaaagatggtatgagatgacgtgctgcttcattgaattgctctttcccccatctttgccaaatctcaatgtatcgttcttaaccccacctcctgtaaggggctttgctatgcttcagctggttgtctcagcagctgaagtgctgcccacctgtgtgagttgggtccaggaaaccatgtctgcccttctgataagggaagatgaatctagagctgggtgaagatctaaattttaaccaaacccctgggcccaggaaaataacaattgaaaatgtacaaggcagtgttttcaatattaaacttccccaaggaaagcacaaactagtctttttggaaagggagaaaggattaagccacacagtattagtctttgaagcagtactggtctctaggggctggtgccaaaatggagtcccatagtagttacactcgatggcctcatgtactatatactgtgccaaattgtattaaacagtggtggggagttactgggataagaacttgtctaaaagtttacaaaccaaaacagatctgttaggttggtgcaaaagtaagtttttgccatacttaatgtattgccattaagtatggcaaaaaccacaattacttttacaccaacctatgtatttaagaatgtttggtttgccagattccaaatgaggtcttcagtgcagcaaagcccaaaaggtgtagactcagttatgcaattataaggttaaggcgtagaagaaagctgctgctaggtttttgttgcattttacttgactgctctgctgtttttcttgtctctcatgtttggttagctatgacttgagcatcttggtaactgacaaaggtcttccttgggggacttgaacatcttggtaaatgacaggtcttcttggaggactccagcagtatcttgtttaaacgactgaaaggactattaaggttgttgaattgtgttaattgggactcattgaggaaatgcgacattgatcctcctcttattccacagtgtgttttctgatcatataaagaaggttccgaaccatccatccccctcagagtttattcccctggtaagctgtaattgcatatccagtttaaactggactgggactgcatgttggtgaggatcggcaggggttttcccccttttcgaaagatgaaatagattcttgagcactggttgcagaagccaaaatagttcaaatagctttgcataaccattgggttctgcttctgattcaggtgctgggcatcatgtcctccctattcttctcttcttggaaacccagcctatctcataaatacctacttccgccacccatccaacctccctgctcctttcaacacaaatcttggatattgccaaaggaagccattcagcagctgctggggtttttcatccccctgacatgcatacatttgctctgggagaagtgtcttccctctgaccctggtccccagctccgtctgtgcttaattgctcttacctgttgcactaatgaatatgactaggttttaaagggggaatgtgaagcaataggcacatggggcttggatgaattggtcccacagatataccctgccttaagccgctgaggtgatgagtccactgctcatgtgaccctccacctttgtggatccctcttggtttgtgaccagtgtgtctgtttgttgaggttgtacaaacttgacaaaagttaatacttttgtttgtattttctgcactgttgcactctccaaatggccccttgagtatttttattgacttgttacacacatttttgtctttgatgtctacattttttcctttaatgttttttatttggaaggttacctgctgttggatttaataaatttgtttacttgaatattgatatttctacaaaaaaaaaaaaacagtgactttattctggggcaaaatttacccactgggagcttctaccaacatgatattgagtaacaatttttattctttgaaaaacaatccagataagtacaggatcctcagactccaaacatgggtgttgacctcccacataccaagcttagtagggtggcttttgggggtctcagtgcttagaggcaaagagcaaataagtcttcacagggccactgcctaaatagtcttacctttgcaactgatgtgaattctcatgaggaataaaaagtgaagttgagcagtatgttaaatgcatgacccctagatttaacagtatggcagtgcattaaggcaaaggaaacaagctgtatctggctttaactgtcaaatgccactgctatgtgaccttcggcaagttagtgaacctctaagtttccttttactcatctgc

SEQ ID NO: 9973 - DNA, 1148 bp, Homo sapiens
tgcactccagtctgggcgacggcagagcgagactctgtctcaaaaaaaaaaagaaaaaaaaaattaggccaggcgcagtggcccatgcctgtaatcccagcactttgggaggccgaggcgggtagatcacctgaggtcaggagttcgagaccaacctggccgacatggtgaaaccctgtctccactaaaaatacaaaaaataagccgggtgtggtggtgcatgcctgtaatcccagctactcaggaggctgggacaggagaatcgcttgaacccaggaggcgaaggttgcagtgagccgagatcatgccactgcactccagcctgagtgacagagtgagaccttgtctaaaaaaaaaaaaaatcttaaccatgtaataagtgattatggttgttggtgctgagtcactatattcactttgtgtgtgtatgtgaggggtgcttaatttgcatagacacttccatttttgtcctttttttctttcaggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacaggtataattttcttggttttagatgcatttcttcttgaaagtatattatttaaaggatatgaataaaaaatgatcttccatgattagaaatttaaaaaatcatctcatacataattaactggaaatgtagagaaataatcttctggtagcagtatttttctggagcggaggggttggcactataggtaagaaaagcactagcgagagacaacttggaaaaggcagatcagaagaagggacttcttccctaatcagaatgtggcattctcaaaaaaaatttttttaagtagtggtaaaatacacatagcatagaatttactgttgtaactatttttaagtgtacagttcagtggtattaagtacatttacattgttgcataatcatcaccactattcatctccagaaatttttgtcttccgaaacggaaactctgtacccaataaacaataactc

SEQ ID NO: 9974 - DNA, 1231 bp, Homo sapiens
acttgtttgttcaagaatttaactgaatgttcttatttgtattagtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaat

SEQ ID NO: 9975 - DNA, 1310 bp, Homo sapiens
tttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaagttcgctagtaaatatctggctattttggctatttacaacactaatttcattatttttatctgtaagcattattaatacatctttaccaaaacctgagcaatacaatattttctttatatgttatatgcctttgtttgctaaaagctaatatttttgcatttactttaaagggctgtactaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatgggga

SEQ ID NO: 9976 - DNA, 1171 bp, Homo sapiens
cctttcctgccacccacagaccgcagctggtcgcttgcccagcagcagagcctcagggacggaggcttgcggattccagggctgagtctgggttccaggtctctgaggctcactcaccctcttgggtcaacaagcgggcccggaagagctgctggggggaggaactcagcagcacccttccccgcatgactctcggcacgctgggacggttctctcttccactgatggggtggctgattttcgagaaaggttggggatgagaccaggacgggaccacttgctgcagccccgcggtcccctgctgggcttttggcttcagatccctgtgccctcctgagcagtgctgcctccctccccgcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgcctgtaagtagagccctgcctgccaggggcatggggggtggggggtggggagaaccagctgttgggaggccacgtggggacacgggaggccatgcttggtgagcatctgctctcacgtgggcctaggtgtgacatgggcaagtcagcctctctgaggctctattctcatgaaatgggatcatgttgggttttatgtcacaggactgtggtaggggctaaatacggtgtctgaaggcccggcctattgcctggcctgcagcagggcctagtgaaacagggcccctgcctggtttct

SEQ ID NO: 9977 - DNA, 1099 bp, Homo sapiens
cctgtgtaatatattctttcaatatttttttccctagacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccagg

SEQ ID NO: 9978 - DNA, 2224 bp, Homo sapiens
cagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttttaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtcctcttcaagccacatttctcctttctcccccttgccaactgatatctttttggtgttgacta

SEQ ID NO: 9979 - DNA, 4307 bp, Homo sapiens
ttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcaaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttaataggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagt

SEQ ID NO: 9980 - DNA, 1099 bp, Homo sapiens
gggtttcttcaccctggcaccattttggtcggacagttttgtcttgcagggggctgtcctgtgcattatagaatgtttagcagcatccgtggcctctacccactagatgccagtagcacctctcccttgagttgtgacaatcaaaaacatctccattcattgccaaatcccactccccccgccacagacacagttccctggttgagacccattggtttaaataagtatgtgttttctaagatgaactggaactgcatctacttggaatggtttggaatttctcaagatattttgctcgagtgtgatacagaatttagaatttttttttaatctctttctgtgttgctatacgcagccttaaaacgttcttgagttaattagatgagccaaagagatggtgtctgtgggtcgcatgaagtggctggtgcagcctcccctggtgctgatggcgggctctctttggcagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggtgaggtccactcttgttcttgggcagttttttccagagcaaaagattgtaatgaatggtctagaggacctctctggaggctctcatgactctgtcagtttgatcagatgaatccttacgtttccatttaatctggaaactaaaatgactgcagtcaaggaagttggggaggaatgtgacagcacctgtggcccagtggagttcactggggacagtgggttggacctggcgcaaagaaagctcatgatgtgttcttgtggataaatgcatgggtgagctgaaaagcagcgtggcatactacccgctgtcctggggttatcctggagcctgtcccatctgggccacatagcaatcatctataatacaggtgtaataataatgcctacctcatggggtcatcgtaagcatccagttagataaatgtgtgttaaaacattttgtaaagggtaaaggaccattagaaatagtctgctt

SEQ ID NO: 9981 - DNA, 1179 bp, Homo sapiens
ttctgtcccaaattgaacttatgtcttatgtcccaagttgaattgaagtatgtccaaattttctttccttttaaaactggctctccagtatttcccatcttggcaaatggcaccacacattcattcaggtttctaagtcagaaatttgggagtcagaaatctctctcaaatttgtctaatgccctctgtaagagtgtatgggtgttttagactatcttttaaagtaactctgtcacagtaggaatgtaacctgagtattaacaagagacagatatgtttcaaggagaaaggactcagtgtttcttaacatttgttagaatagcctttatgttagcctttgaaaattttgctttgaaataagttccctgcatagtaaataacataaatgtaaaatgtgttgatatgcatatttatgctattcattgacaggtattttagtgtttacagtgtgttgggcatggttctaaacactggggattcagcagggaacaagacaggcaaggtctgtgtcctcatggagcttccatcctagctaggacagaccgactatgaacaagcagacgtctttaacttcagacagtccgtaccacgtcgaaggcattaaaacagactagaatgatagagtgtgatggtgggaggctggcaagacaacattaggaagggaggtcagggaagacgtccctgaagagaccgcagccaagctgagccccagtgtgctgtgtgaacatggggggaaaggatcccatgcagagggaacacccggtacatgcacacaagactaggaggagcttggtgtgtgtcaggcacagaaggaatgaagtaaagaacctgtggaattcccttcatgatgctagtctcttaaagagtgaagtcattattttaaaaaaatatggttgggtgatttacatgtacttgtaactcatttcacctcacagtagtttttaggcagattggttcactgttaagcaccactgtgagcgaacagtttgatagttgttggaaactggtttcttggtgatcttagcacctctacttccctctgggcctgagtcagagttaatctgttagatcatttgttcattcattcattcatctattttctagacattgtctgtttgcgctactaagataaataaatcacagtgcttgctatcaaataactcacagcctattggtgga

SEQ ID NO: 9982 - DNA, 2187 bp, Homo sapiens
tcgctcttgttgcccaggctgaagtgcagtggcacagtctcggctcaccacaacctctgcttcctgggttcaagtgattctcctacctcagcctcctgagtagctgggattacaggcatgcgccaccacagccggctaattttgtatttttagcagagatggggtttctccatgttggtcaggctggtctcgaactcccgacctcaagtgatccgcccacccctgcctctcaaagtgttgggattacaggcatgagcccctgtgcctggccaatattagtacttttaaagtggttggggattacttattagaggagattgggatgggggctttgagaattggaggggaactggagcatcctggggaaggggagctgcccggctgagtgctgtgcagagacgattgctggcagagtctgtgtgaggggatgagtccacgtgacccacatcctactgctgtgttctggctcctttagcaggtgcccgtcactgaagtatctgcacttgatgcatagcttgtaaaggaagtcaagatcatatgtgattctctagcttcatcttcaaccaagaattggtctttctagtctgtgaagttgtactttcttttttttttagccaccatcagagactgatatgatgcctgagggaccatctttccctgtctgtagcacttttgtacaagaactctttcaagcgcaatacaggtatgagaaaatcggatgtttccacttattttgtttacctgacatcgttctgggtgattttaatgtcaagcgtcttacctttttgttttgaagatcttctttgacgtgtcctcattgtcagaaacagagcaacacttttgatcctttcctttgcatttctttgccaattcctctgccccacacaaggtaagaatggatttagtaaaatgaagactgtattttcttatggtatccctttgcctctgtaggctcctattaggtcttcttacttatttagacaggtaatgggattaataatgggattgaatacagtcattgctacaaccttacaagaataaatgccctcctgagtttgcagggtgagcaggcacatgaggcaagcaggggctgtgtagtctggcccagttcgtcatccacacatagtatcggggttgggggacgggggctgctgagtgacttcaggattctctagagaccttactttacatttcttgtttcttcgttgctttattttgaacaatttctcaacatttccaggagttatgctgttctaaagaaaatacaaagcacagaatcaagtgtagatatatttttgtttgcttcatagaatgttcattttatgaagattgccttttccaaagatcttgatgattgtttgacagttctgcttagagccaagtgaaatttttccatttgggcttccgagtaacagtgtgggttagctttagttttttgttgatttcgtctcaggtttattttgcatcttctatattttagttgaaataagtgactaatgagaagatctgactttgatctgtacaggcctctctatgtcactgtagtgtatcaaggcaaatgttctcactgcatgaggattggtgtggccgtacctctgtctgggactgtcgccagacttcgggaagcagtgtctatggaaacaaagatccccactgatcaggtaataagtctgctaagaccagttacacatgagccacaaaagtattgctttctgttctcttagaattttttacagttctttgccaagtatggttggatagagatttaaaaccagttgcatttagagtttagggaaaaaaatcaaggccccaaagactaaaatgtatatagaaacttttcatgtttcatttaattgtgtatataattttaaaagaagctgtgactttacaccaagaccttcttgtagctttgttcataaggtataattacttaacccttcttaaatcattcctgtggatgtgtatgtgggcagtggagcgtcctcgcagtgtttgagatagtcaaagaggctttgaaaacttgagcagtgacgctagaaaaccccttcccattgtgatgataagagtggatatcttgctagtacaatgttctgtacgtaatagatgctcaatacgttttgttttctcattacggctggaccagagtctcttaccttgtttagagaagagaaaggaaagttgtgccca

SEQ ID NO: 9983 - DNA, 1147 bp, Homo sapiens
cgcctaggctggagtgcagtggcacaatctcggatcactgcaacctctgcctccccgcttcaagcgtttcttctgcctcagcctcctgaatagctgggattataggcatgcgccaccacacctggctaatttttgtatttttagtaaagaaagggtttcaccatattggccaggctggcctcgaactcctgacctcaggtgatctgcctgtctcagcctcccaaagtgctgggattacaggcgtgagccactgcacctggccagatgcagtagaaaattatccacagcctagagctctggaatgaactgcacagggggcctggacatgtctgaggcttcagtgctattctcccagggcctccccatctctttgcaccttgacccaccaactggttgcattgagcttgacaaacacttcgtaaagcaattctggaaactcattcatccatgcttctgtgattaggttaaagcaactctgtttatctttattgctaatctgatttatgtctgttgtaatcagttcatttataataacaaaactaaggttacactttccatctctattttctcaggctatttggaattccttgggactcatggaggttgtacatactttggctttcagccaagtatatttgacctgacctccccgggaattagggctctgtccatcactctgatttatatgtgaagcttctgatcttgtttcccccctctttcccacctcctctatccctgagggatggtcacaggtgaatttttcctaaactgcttgtccatgagctcatgttagcccaagtgcatcagaatcacctgggaaagtgaatttaaaatctagatttctgggctccaaccccagtgaactctgatgcagtagttctggggtggagcttgggaatctgtaattcagcatgttctccagaggggcctggggcacagccaggtttgggaaccactattgcatagaacccccagttctcctgtgagttttcaaaatggttaactagctaatacttgggttgggtttcaggcctaacaactgccttttgcattttcttgtcttaggaaaaagggtcaagcaaccacaacctgctggctgcacctcgagcagcgctgactcggcttaaccagcaggcccaccagctgg

SEQ ID NO: 9984 - DNA, 1247 bp, Homo sapiens
cagggggtgagcagggcagaagggagaggcgagtggcggggggaggtggggcaggaggtaggggcgagttgctaaggaaggtctgtgctctttgttggcagtttcttctcacgattctttgtttcccgtcatttctgagaccaccaactgtctttagtccaagattttttgtgatggttctcattatggggaaaggctcacagcaggatagagtgggagcagctgctgctgttcctaactcactcctgaatgcccagcacagaaattgcgtgactttcgggagtgaataaaaccaaagtgccacaggcatacagtagagtgtgtgtaaataatataaatgaagtaaatggtaattcctaggacacagattttccttaatctcttaatgaaatcaagtattacattctgaagggtaaggagagactggttaggagcacgaatggggacacaatagataaaagatgggcctctctgggctgcattttgcagcccagagaggctgaaagcctggctgagcttcaagtcaagaacagcctgggtgtatccaagggagctcctgaaagagatgatgtcatcctggaagcactaagcctggaaagggacagtcaccatctgtgttcctggctggaaggctgcacagtgtgcatgcgtgtgtgtgtgtgtgtgtgtgtgtgcgtgcatgtgtgtgtgtgtgtgtgtgtatgtggcaggcacctgtaaagcttatcttatctccccatcaatctcaccagcagcacctagactcctaccaaggaccactccccaccaacaggcgggtggcagaggcaacaggtcagaacgcgctgggccgctccagtgacaagattgacattggccacccagctcttatgatcacttctctgcagaaagggatcattttgtgatttacgggctgagtaaagcaaggccgagttgaaatctcatctgagagatttctctcatcctgggcagcttgggccagatatagggagattgctgtggctcctctgtattttcctagcacccattacttacttttggaacagtggtgctttcatttcactttgtaccaccactaaaaatttcatcacccagagattactttagggcaataaagaatcacctaagaaggaggttaagggattgctgctggtccctcaaacaactgtatgaaacagacttcttccccttaactcctaaggaataaaggcatcagccataccaagggaatcaagagatttcattta

SEQ ID NO: 9985 - DNA, 1101 bp, Homo sapiens
ctagccaacaggtaggagagaggagtcattgtcctctacaccctggggttcctgatcagcacgagcttggtctagtacacagtacagcaaggacagcatatgccagatgtgaaggccacagggctggaggactgtctgtacctagatacagcgtgtcattattgtcatcattaaacgtttattgagcacctaaaaagggcaaggctttgtcctacttggcaggggtcacgtaattttggtttgatatggtggtttcagcctaaatgaggaaacagtgcatcttgtctccaaattaggaatgggcttggttccgactgcttgtttataaattagttgttgggactaaaaataaatttccatatagaaacggtgtgacaagtggtggtgaagtcccttgggccagccttcaggatcggggtgaacttaggcagcctgccttctgggtcctgcagtcaaattccgtgctgctgaagggctgtgtatcaaaggggaatctctggggtctgccctggaaaagcttgtcctactcccttcctctcttctcatacctgccagggcttttatgttgccctgaggtggccttcctcagacagtttttcccttcaaggggctctggcttcccacatttctttctttatccctttaaatgaaatctcttgattcccttggtatggctgatgcctttattccttaggagttaaggggaagaagtctgtttcatacagttgtttgagggaccagcagcaatcccttaacctccttcttaggtgattctttattgccctaaagtaatctctgggtgatgaaatttttagtggtggtacaaagtgaaatgaaagcaccactgttccaaaagtaagtaatgggtgctaggaaaatacagaggagccacagcaatctccctatatctggcccaagctgcccaggatgagagaaatctctcagatgagatttcaactcggccttgctttactcagcccgtaaatcacaaaatgatccctttctgcagagaagtgatcataagagctgggtggccaatgtcaatcttgtcactggagcggcccagcgcgttctgacctgttgcctctgccacccgcctgt

SEQ ID NO: 9986 - DNA, 1888 bp, Homo sapiens
gagaagagaaaaagaaaagaaagtcagtctctggtttggttgggtgttaggggtatatgtggaatatccctcgctggagtctgtctttggggctcactgaaggaagatcagatggattgtcatagctggggaccaagggagggacacatgaactctccctaatcctctggagtcctctgaaaggacaaggtctgtcttccttagctggtctctgaattgcagcccatctcaggatttcaggactgcagaattatcgaagggttcccaggatatgtgcctgtttccccttgtttgtagtcccaaagagagtatcccaggtattttgtgtcagaattgtttgaaacactcacttgacttaacattgacccctgttcctgggttgctctccactgatttgacatcttctgtctcttctgtcccaggaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaact

SEQ ID NO: 9987 - DNA, 1272 bp, Homo sapiens
cgccactgcactccagcctggcaacagagcaagaccccgtctcaaaaaaaaaaaaaaaacaacagaaaagaaaaccagtggtgtattgggatagtcagagtgcctgcatcgtagtgtccttggaccatttggtgagatggtgcatgtaaaatgtgtgcactgttgttagtgttaactcttctgttgctgctgcttctgctctaggcctgagggagttgtggtctcacctactcttcctgttcactctctgcagcttctgacaaggcttctaaagagcaaccaccccgaggaccttcaggctgcaaaccggttaatcaagaatttggtcaaggaggtgggcattcttccagttggttcagtagaagtagcatttgacagaggctgaaggacagtgcatatgagcctatgcttgaggggtagaggaacggttgcctgggagaaagagtggctcctagccctgaactctggggaacagccatagtctccctcaagggcagcaaggtggtgattggaaccagaaatcccgctgccgtacttctcagctgctttcatccatgctgctcaaagcatttcctagacaccagcttgggtcccagcaacaggtattggtatggacaaagtccaggtttaggaatctgcttttcagaggacttgaggctggtggcacaaaggcagaggtcatggtcaccagtccccaaactgcattttcctccccaggaactctgggcttttgagtattttttcacccactgtgtgagttctcccatgcacttaacatcctggtgatgcccctgagcgagctctctcaatagtgactctttcccatcccttgttcaggcttcagccagggtttctgctccctcactcccatcctcctctttttcccaaaaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtaatacaggtgtaacacagggggctgcacatgtttactaaagtgggtttgaaatgctttcacctgtttgcacccatgaagccatctcagagtcaagacggtaaacatatctgacacctccccaaatgtcgttgtgctgctttgtcctccctttgtctgtcccttgctccccagtccccaggcagctgctaatttgctttctgttctgattggctgacaactcccagactcttgtataaatgg

SEQ ID NO: 9988 - DNA, 2188 bp, Homo sapiens
caccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcaga

SEQ ID NO: 9989 - DNA, 1048 bp, Homo sapiens
gctttacctgatgagggccaaagagattaactctgcctcgttgccatgtctcagaaaagttgccatatttcacccagaaggggcttgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaattgcgtctctttttccttccaattcttcatgcgcctaatccatactggggattaaccaacatttggaattggacctggagccatttctttgccagttgtggtcttatttggctttaagtatattcaaatgtattctctgctgaaacagttgacatttactctgcaaaatggtgaaagtgaccggtgtgacagtgagccacactcctgttggagcagcatggtctgctccttggtgggccctggcttccacatgttggaagagaagctgcctccctgtactcacacctcctgactagtgccttgggcaacccca

SEQ ID NO: 9990 - DNA, 1195 bp, Homo sapiens
ctgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatatttcatgttctctaaatgaactcacctacaataacttaccagcaaatgaaaaccaaaacttaaaagaacaaaatcaaacagagaaatctttaaaatctcccagtgacactcttgatggcaggaatgaaaatcttcaggaaagtgagattctaagtcaacctaagagtcttagcctggaagcaacctctcctctttctgcagaaaaacattcttgcacagtgcctgaaggccttctgtttcctgcagaatattatgttagaacaacacgaagcatgtccaattgccagaggaaagtagccgtggaggctgtcattcagagtcatttggatgtcaagaaaaaagggtttaaaaataaaaataaggatgcaagtaaaaatttaaacctttccaatgaggaaactgaccaaagtgaaattaggatgtctggcacatgcacaggacaaccaagttcaagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaaggtaaatcaagatgtgtttgatgatgatgatgatgatgatgaaagttaacaattactatttgcctggcacttccttttctttcttttctaaaaagtgacagggccaagtgtggtggcttacgtctgtaatcccagcactttgggaggctgaggaacagagtgagaccctggctcaaaaaaatttaaat

SEQ ID NO: 9991 - DNA, 1197 bp, Homo sapiens
acacagctgaaatcatgtagcatatacagaggcacgtcataaattcacagatggaaaataatatgaacagagagatttgacagtatatgatacctaccactgagtggtttaattgtttttccaattaaaaaataaatctcatctctcagatcattgaatctgagtttctaagatgaacaaaatcatcactcagattcttcggggaggcatttggccattctaccgtgtcatgcatctctgcttttgcagaggaggaaggagagacttttgtttagtaatttctccatattggggtcctgctgtgaaaaagtttagctgttcttagcaagcactggaccagaacagcctcagcgattatttaagtgattgtcagacatgcatctgattgaggtgagaaggatattgccagagaaatatcttaacttcttgtaacttcttcaagctccttagagctgggtctttctttccccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagacttttta

SEQ ID NO: 9992 - DNA, 1157 bp, Homo sapiens
tgggatctcactctgtcacccaggtgggagtgcagcagtgcaatctcagctcactgcaatgtctgcctcctgggttcaagcgattcttctgcctcagcctcctgagtagctgggaccacaggcacccaccaccatgcccggctaatttttgcatttttagtagagatggggtgtcaccatattggccaggctgatctcgaactcctgacctcgtgatccacccacctcggcctcccaatgtgctgggattacaggtgtgagccactgcgcccagcctctttttattattatacttagcacggcacttggcacttaggaaatgttcagtatatgttagctattattggctactgttatttcttcttcttctcctcctcctcttcttctttctcctcttattcctcctcctcccccactcccttccaccccctcttcttattcctcctccttctcctcattattattttaagtacctccttaccaatgcctacagaaatagactgacctagtaccaggatctagaggagttcaatcaagttcgtctgttgccttcaaggtaacagcgtagtggtggttccgagccagatgccagacccagtctgcctttgttcaaatcctggttttacacttaatactgtaggtacctcgggcaagttacctaacatttcttcacctcaatttctccatttgtaaaatgtatataatgatagtacctaccacgcatggttgttaggaagattaaatcaattaatatttgtaaagtagagcagccggctcattgtaagtattgggagtattggttaaaataattacaaaataaacaatctcacttagatacatcccttaccccctgtggattatgtcaagggtgaaagaaacagtgtgcttgaaatcctgctgtgcgccgagctgtatatcagaggtgttatggtgattcgtcatcattctcctgaccactttccatttttcttttagagtcaacactggccaatctttagggaggagctctgatcattgagaaactgacactgtggaagggggcatttctgactctctcttcctagctccatttgatcttcctaaatctttcaataatgtgtcattggggtaggaccaaagaaaaacggggtgaatgtacggttgctgctttgtttccc

SEQ ID NO: 9993 - DNA, 1595 bp, Homo sapiens
ttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggaggga

SEQ ID NO: 9994 - DNA, 1203 bp, Homo sapiens
cagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaaggtaagggccgcttggtcttaagatatttggtggctggagagagatactagctagaaggtgcctggcaggaagctaaccgccattatgtctctagtggggactgttcgttctagtac

SEQ ID NO: 9995 - DNA, 1150 bp, Homo sapiens
aggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaatagcactggacttggttcccaaaacaagtttgtagttggtagcagcagcaataatgtgggccatggaagtagtactgggccatggggtttttcccatggagccataataagcacatgtcaggtctctgtggatgctcctgaaagcaaatctgaaagtagcaacaatagaatgaatgcttggggcactgtaagttcttcatcaaatggagggttaaatccaagcactttgaattcagctagcaaccatggtgcctggccagtattagagaacaatggacttgccctaaaagggcctgtagggagtggtagttctggcattaatattcagtgcagtactataggccagatgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatgg

SEQ ID NO: 9996 - DNA, 2668 bp, Homo sapiens
ccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattctttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaattttttaaagtggtttggatctttgcctagtccttaaataaatacagctctattccctaagccacccttacttctcggtcttaatcccgactgccagtgcctggatgctgccctttgtctggcacagacctgcagctgaccatgctgggcccatggctcggggctttctagtcacgcagagccaccaagagtcagggtaaactttttaacacaggcacttaacacgttttttctttgttttcttttttccttttctctttctactttcttcctttttcttttttctttctttttctttctttttttttttttctttcgacaggg

SEQ ID NO: 9997 - DNA, 1147 bp, Homo sapiens
ggtacccaggcctgtccagcccaatcagttgagaccagggagaccagggattggcatcagcaagtacagcactagccatttagtgctataccaagaagactatctactttgataagtaagaagcagatctgggggagtaacacaggcttcctgattctcatcatgaatcactttctacattacctgtcaccttctttcccgacccccgacccccgcagggatactgcatatagttgttgaagctgtgcactgcacaaccctacagggtgcaatctgcattttaggccctgtagtcctgaatatttattctaccaatttctgacaggtgggctctgaccaagtaagagtcttggggaagaagaatctcattctaatgtaaacaaaaatgccagataggctaggggtggccctgccttcctctacttctcttctctgtccctttggagcatggaaataattgggggtggggagcaggtacccttgactttgtctccaagatctgacccgtccatctccccacaggtgggtgcatccttgtttgccagcaatgttggaagtggacatttcattggcctggcagggtcaggtgctgctacgggcatttctgtatcagcttatgaacttaatgtaagtattttacctagggcatagatgacatcttacctctacctaacaggtagatctcaggggaaagttgtgtgaatgccctgcactttaaaaatagaatggtggggccaggcgcggtggctcacgcctgtaatctcagcactttgggaggccaaggcaggtggatcacctaaggtcaggagttcgagaccagcctggccaacgtggcgaaaccccgtctctactaaaaatacaaaaaattagccgagtgtaatggcgggcgccgtaatcccagctactcgggaggctgagttaggagaatcatctgaacccgggaggcggaggttgcagtgagcagagattgcactactgcgcgccagcctgggtgacaagagtgaaactccgtccccctccccacaaaaaaacaaaacaaaacaaaacaaaaaaaacaaaaaaaaacacacacacacacacacacacaaacccaaaaaacacaaaaaaaaaacaatagtgggttgggcgcgatggctcaggcctgtaa

SEQ ID NO: 9998 - DNA, 1226 bp, Homo sapiens
tttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttatatgaaaacttcataattcttggaggtaaattgtggagtgtgtgtgtgtgtgtgtgcatgagtgtgtgtgtgttgccactcaaccagatagaattgtggctgggacatcttgggggagagggtctaattgtagctgtaggagtttgaagaaacagagagcaaggtcgcaacagtgaaaaaggccgccaggtgccccaaagacctcctagcctggccatcctcagtgcaggttctggtcaaggctgcacccttggtcctcccagtgctggcatccctttctttccatctagagatactcagactcccgggggcagctcacaggagttcagccccaccgggttggtgcattcgtcagcagttgtgaattgccatagagagccctttttccaatggctggtgc

SEQ ID NO: 9999 - DNA, 1102 bp, Homo sapiens
ttgtatttttagtagagacggggtttcacgttcttggccaggctggtcttgaactcctgacctcaagtgatccgcctgccttggcctcccaaagtgctgagattgcaggcatgagccaccacacccagctaaatgtctctttttgaatgattcaaataagtgatctgtgctcatcgtcctcttctacattctagatttgtttttatttattttttttccacaaaagagaaagcacaaaagtgtgtaacttatattctgacccatacttcttcccctgtcttgtcctcttaacattacttcccactggtttgatggaccattcttgcgatgtgagtgcctggagcttccactttgaaatagtgagggctgtggactgaagaacgaggttcccgttccaatgaggggtgtcttagagctccctcgcctgctgtgctcagtgtctcatgcacttgtttatttttcctcttgcagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaaggtatgatttgaccgttcacttccaaaccagcagtaaatatgttgttagacccgtggtatctggtatcgctcagtggacttgggatttgagagtggtcgccatccacccatgactgatggtgtccagatagtttctggaattctgctgtaggtcattccaagcactaatctcaccataaagtcagtgtgtagcttctcagttaacgtttcttccacgtgtattccagcttaacttggtggtgtgcttggtaagccctgcagtggaacggcatcatacacatgttaaaagtgacccagatgtacgtgagtggggggaaacagaaaggaaaataaattcaatagtgtggacttttgtccagaattgagtgtgagaacacccacctggcacagtgagttgagtgatttggcgtttaaggagacatatttctggtataatgtggccccacaatggaagccaaccactgaatttgatgtt

SEQ ID NO: 10000 - DNA, 1309 bp, Homo sapiens
gaccagaccctttcagttcttagtcacatcgtttacaggcggtcaccaaaacgtccatggtagttatctaaaaagagtgtattttctgaattacttggattttttttttttttttacaattgtcatgtattctttaaataatttatataagtaagaacaaagcagtttttattgtaggagggaaggtatacccttctgtctgctcctgcagcaaggctggtgttctctagccctgtctgctctctctggctgtgacatgggccctgcttcccagcaggacgaggccttcagacttttcagtccatttctcagcgtctacagttatctcgctgtcctagaacagtttcctcccattcgtcaccattcctttctcctgtctgcttccatgtttgggggccctgggaggagggtggcctgtgcccacctgccagcatcctccttccctccagcctggaagtttttcctgtttgtgcttccacatgctatggccatcctcatcacaccagagtgatactgcgtgctagcatggttataagtgttttccaagtaatagctcatttaatccttaaaacaacctaggaggtaggtcatatcagcacttagaaccatgttaacacacaacatcactcccattttacagacgaggatactgacagagagggcagggaaattgcctgagaccccacagtgggagaagagcaaagcctgtattcagacttgggcagcttggcaccagagagcatgttcctgactatgacaccatggccacctcacaccaggcaacgtgcatttctggtgtcaaaaaaaccccatagagagcttgcaggggtggaggggaaggaaaggagagagggaggagggagggatagagactgtggagttatatcactgcacgtgtactttgtatgatatcagctgcatgttcgcaagcaaactaaaaggaaacatgatatttatgtaacagggcccttaagtgttagccagctagctcatctgcatagcagaaagggagcctggccaaggctggactcgcagacataagataacatggaatgaacttaatgtctaatttaaaagatcttcagagtattttgtgaacacttggctttcacctgacttgagaatttaattcttgagtaatttgttatttcactgttcacacatctgtctgccacccacacacacaaagtgcatccctgagacagtcatttttattttaaagcacaaatctgtggactcatgttttaggcagtaccctacatttataatattttcaaggctcgttaggtagcaccctaatgcgttcctg

SEQ ID NO: 10001 - DNA, 1178 bp, Homo sapiens
gcctctgctcaatttctccaaggccatagatctggtaaaaaggctcagccaagggttagacccagaattgcctgatagtaaaaatagctcagacttatttagtgcttactgtgttaccaggctattacatgtattaacccatctaatcttcgtagcagttctgcagaggacgtttctatcattagtcccactttacagatcagaaaccaaagcctgtggggactaagttgctcaatctcacacgcctagtaagtgggagagccaggccctgaatcccggcattctagctccagaatccacacctcttaccactgcccagtcctgatgctgtgactcgtgttcttcttctcacctttgtagtaaacagcatgaagaatgacttttaaaaatgatagcaaatttatatttgttaatgtaaattagtacaagacccaggacgttgcttctgatgtgcttggggttgactagtgtcatttacttccttttcagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgtgagtaccgtttccctgttcccagggcgctctggtgctgtgttgatcagggaccagtgacataggtacaataccatgtaacttgttaaccggtactcctgagctgagcattcaagcctcttcacaatcttacacgggcccatctttctaatttcatcttccacttttattttttttccaagtaaacctgacatttagccctgtggataaaaacttagagtctaaagctgtatagttgtggttcacaccaagcctccaggacctgccccagcctcagtttctgtatctgtaaagtgaggatagtaattgtacttaacacataagtaagtgcatggttcagggaattgagagacatgatatgtacaagacagtggcgcagagacagtgcctagtggggtattgatggacacagggcagcttggctgggtgcggtggctcacgctgttatccctgcactctgggaatcaaggtgggaggatagcttgaggccaggagtttgggaccagcctgggcaatgtagcaagaccctctctattttttta

SEQ ID NO: 10002 - DNA, 1143 bp, Homo sapiens
ccccactcgtgggccccgggtggctgttcagtctctggtttagtaacagaaacgtctgtttcgaggaaagtgtgcctggaactctgcacatggcgtggagcagagcttcagggtcacgctcccgtgagttttgccacagcctggaggtggtttctgcctgggctgccagtagagctggcaagtccaggagtcacaacccttgtccctctcctgccaatgtgggtgggcccactgaggcctcagttacagctacatcagagcggacaccacgtcctggttccacccagctggcggtcaagggcccctctgtccagacaggagagaagcagggagtttggaaagcagagagcaagaggtggctggtctcagccctgtgacctgggccaggcctaggacgcccctgagcctcagtgttctgtctggacgagctgccctcctgcccccaccaagccctgatgtcaagccctctccctgcagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccaggtgtggggccttcctgggttcagcagggtgtggaggcggctgggtgcactcagtggcccggctgtgatgttcaggccccaggcaacatgcagtaccaccatactgcttgcctgcacctcctcccccagcttgtcctgggctcctgcctctcaggctgtccctcagtgtccttcaccagctccatgctgctgaccaggctggaagatggggtgcccggggtgcttgtctctgatgctttctctgtgccaggggtcactaactcatgagtccgccgggccccacgggtcaagcagctgccccctggtgcagctgcttcctgcttggctgactcccatgtgtgcctggggcctccagctcctctggcagctaggagcttgaagttgagtgtcaaattccccatgagccaaacaaaaccccacctggaagccagtcttggctcacaggaagctgggatttatcccgcgctgcaggcc

SEQ ID NO: 10003 - DNA, 1209 bp, Homo sapiens
ggtctggccacgtgctaggcattggccagatacagacgggcaggggtcagcagtgccttctgggagcttgtgggatgggagttgcagatgagtgactggggattataggccggtgtctaaggtgtcctctgctggtgcctcccaggtgttatgggaatcagccaaagagaaggacgcagcacagcggggcaggggaggggcagggaagagaagggaggactgttcctgagggcctcgcaacagaactggggcttcctggggaaatgggtgttttctgggctgagagacgggcaaaaggaacagtccccacagagatacagctatgtgacaaggggtgagcgcggtgcacgggaaggtgggaaaggggatggatctggggcagccatccacaccagccttggtaatgaagcatagccagttgctggggccactgctgaagcccagccacagaggcctcttgagggaggggagaggctgcagtagcaactggctggcctatgctcaggtatccaggtcacaattcccttctagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctggtgagtgctcctgctggtgctgtgggagggcctggcctcgccatcatccaggaagaccctgaggcctggcctgggacctagaccttcaggctccccaggccaggcgtgcagccacagaacacacagaaaaacacaccccatccttgcagccaactcaagggatgccttccccaggtgcctgtgctgtgcccacacctctgtgggaaagctccccgcaccgcctcttttagtcacagctgtgctgcaggcaccagcagtcactcaggtgggctcacaaggaagagcagagcacttccgcttccccaccccgcccactctccacgggcggccctgtcactgcccgggctctagtctcctggtgcttagctctgcaactctaaagtgtgtgctcttaggaaacttttaggtattatctttt

SEQ ID NO: 10004 - DNA, 1194 bp, Homo sapiens
caacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacaggtgagaggcccctgccactcctgcacctggggcgggcaggcccagtagtaggatccagggagaaacatgatagttccttttccttatataaactggctgcagcctctgatccaaatggaaacataatccacacttcctgaacctgcaggctttcttcctcatcttccttcctgcctgacaagtagagttttcctcaaattaggggtaaagacaccaagacctcctgggagatgacgttaccatgtgtcaccatggtgactggtatcctggctgccgggggtaaccgtgcgtttttttcctagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtattggtgacaggagccattatcacaggaattgcccctcagctctgggctggagggcctacactcacctgggcaagggaggatacttgaagacccggtgttgcccagatgaatggattggtggatagatggataggcagatgctcattcaagggaaaatattttaaggatttgttcgagatagattagactagattagattagaaagatgattgggtggatgggtgggtggttggcgggtaaatactttaaagactcgctcttctaaatggatctattggtaggtaggtagacagaaagacaattatattacaacaataaaacgtggttttttttgttttttttttttgttttttttttatgagacagagtcttgctctgtcgtctaggctggagtgcagtggcgcgatctctgctcactgcaacctctgcctcccagtttcacgccattctccttcctcagcctcccaagtagctgggactacaggcacccaccaccacgccaggctaattttttatatttttaatagagacggggttttgccatgttagccaggatggtct

SEQ ID NO: 10005 - DNA, 1157 bp, Homo sapiens
ctttgtgtgcccagcatggtattctgtttggtttttaattttatttcattgctaatatttaaaaacctggatttctagcttttcttgaaaagtcacaagatctagctgcactgagaccaattttttacagggtgatataggccagagttaccctcagctggccatgtaccacccggttccacacaccgtgagtttgtgttcgtgttgtgttcgtgtgtgctccctgccctcctgattgggtcccggcaggctatatgtgattgtgcctctgctcacccagtgctccgacctcagtttcttcactctgcactgcacttcagcctcaacatgctgggctcctttttgtctcaaggcaatcctcgtgctgttccttcgccaagaatattctgtccacaaatcttcacgtcgccacatcattcagacttcaacctgactcctctggaagtgtcctccattgcccagacaccatcgtagtactctttatggcaccaaaaatggttttaagtgtttgtttatgtcactgtttcctcactagattatacgttgctcaaaggcagggactctatccttcttgttcaccgctatgtctctcagttctataataatatgcctggcacaaagccggcttctagaaatacatgtttgaagttgtaacccctgacccatgttatagaatctgaactccccagcacggcatcagagggccactggggatgtaggcgctgctggcctctcgagctttccttccttccttctgcttcctagctggctaccacactccagactttgtagccgtgctgcacctcttacctccaggagcaggcatgcttcttcatgcctctgtaaccgtgcagcttctgcatccttccccttaattctctcattcacacagctcactgctaatacaagcgtcacctctttgcctggtgcagtggctcacacctgtaatcccagcattttgggaggccgaggggggtggatcacttgaggccaggagttcaagaccagcctggccaagatggcaaaaccccatctctactaaaagtacaaaaattagcctggcatggtggcaagtgtctgtaatcccagctacttgggaggctgaggcaggagaatcacttgagctccagaggcagaggttgcagtgagctgagatc

SEQ ID NO: 10006 - DNA, 1171 bp, Homo sapiens
aggccgtctctttgtgaaagtcctttgatttatagagtatgtagcggttcccacagaaatgagaccaagcctagtttcacacccccagcactgtggttttcaaaagcttgcatttctagcatttcacattttcttttctttttttggtatcttcgacttccaaaatttcatacatcagtctgatgctatgcatcttcactttgttaaatcttatggtttcaggatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagaggtaagctccaaagagcagcccgacttgggcatcatcatcccagcccctctaattggcatgaagccagtt

SEQ ID NO: 10007 - DNA, 1159 bp, Homo sapiens
tgtagataatttggaaatgcagaaaaatagagggaaaaaaatcatccataatctacccactctatcctccccctaaaacaagtggtaccaataagcatattttggtgacacttcttcccgcctgtcttctgttaatagatgaacattcacgatgtattctgtatgtatatttagtacaaccatgtcatgtttaaaacatcctgaatatttatcattaaatatgcctctaagcatggtttttattgtatatattgcattgtattacctcctctgggttggatatttatattgttttcaaagtttttgacaccttcaataaggctttagttaatatgcttgtatataaatctttatgcatatctcagattatttccttggcataaaattgaaagtctggtcttgattcttttttgtatatgaaaaagtctgcccttacgctctttgctggtaccagccttgtctgttttgtctgtcttagttcataagctgaatgttcttgtttacctgcctctttgccaacaggttggtcaaagtcactctgtacggatctcagataaaattgtacaacattgaaactgctgtgccatcagtattgaaacctgacctcattgatgtgtaagtctagagtttgatgtttgtgcatttttaggaaagaccttgcccccaatctccaaataatttgattgagaaaaaggaacagtagtggctgccatgaatcagggaaaaactcttaaactgcaaacctagaaagagagagagatttttttgactatatgtctggggcagaggcggttggagaaagtggaattaggtaagtgagagctgggatggagattctatggagtaggcatttcaggaggaaagaacagtacaggctgagacagtcacacaggcaggaggtggctactccatgtagtgcaagaagagactggataggtgtgttgggactaatgggaaacacctcagatgccatcagtctttcctgtagatcattgactaaaactgtaggatactgtaggatgcagaagaatgcttggggaacacatttctcagagattctgattttagcagaatggcataaggccataaggcttgggtatttgcgtattaaacaagaaccccaggttattttgaagcaggacatctagagaccacactc

SEQ ID NO: 10008 - DNA, 1175 bp, Homo sapiens
tttggtgcccaactttgtatgtggtgttagggatttttatttgtttatttatttaatggtcatgtatcatgcttttcaaaagcaaggtcatgatttgggggaacagtagcaagaaaacaaaaacttgagtggatttggggttttgcagccagagaataatcccatcttctcttcacttatgtctcctgggaaactgctgttgtacaaatctcactaaaactaaatttgagtcaaaacactaaagattgtatccagatccccctcactaagaatcataatcaattatcttatttttgctgtactgttaaaatttcctaattagtgtttaactttgagcatatagattttatttttttatttcataggtaactaaactgatacatatatgtatacatatatatatatatttttttgaaggagaattacttaaagtcatttgtaagagatttgatgctggatagcttaaaagcctttcttattttcaggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagaggtaatgaaaccaagtgtggagctggtgtgccccaagaaagggccctgactgtttaccatgctgtgctgcatggcatctgtaatcctctttgatttcagaatatggggctcctggtgaggaacagaaaggtaggtgtgtgccagtaagtctgagattagctggaagggcttgggtggttaagggaagtgactgagtttgaaaaatgcttgtgccttgtgtaggtttgttgtcttttc

SEQ ID NO: 10009 - DNA, 1250 bp, Homo sapiens
taaaaagagctacctaaatatcctctaagtgatgtttcttttttttttttttttttgagacagagttttgctctcggtgcccaggctggaatgcaatggcacgatctcggctcaccacaacctccacctcctgggttcaaacgattctcctgcctcagcctcccaagtagctgggattgtaggcatgcaccaccacacccggctaattttgtatttttagtagagacgggatttctccatgttggtcaggctggtctctaactcccgacctcaggtgatccgcccgtctcagccacccaaagtgctgggattacaggcgtgagccattggagctggcctctaagtgatgtttctgaagtgttgatttatgttcatgtaagattaaacacacacagatgcttcatagctttaatgctactgagtcctctttgtactttattagtccaacactctgctcagaacatgctttttcctggcagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtgagcagtatggtagtgcccagagatagaggcctgcccgcaggcacccagagttcaggccttggcactcagcagctttgagcagttgtttgcgctgtttctgagatagcatgaaaatgggaagctgcgttcccaacacctatagcccagggtctagcacacagtaggactacaaaatagatttgtaccttattttcctcgtagtctttcacgaagtggtcttcactgtaactgtgatcagtgaggtagagtccaggtcataggagtatacctacagtgccgatcactgcatggtaagttaggtgggtggcaagcactctatttaaaataatttgaattgaagatcaggagaagttggagtaggaggatatgaaaatttcccgttctgggtaaggaagtgagacatggtgtggagccagccccttgtgcactaggttgtagttgtatgtagcattttgtcttttctgtttgatgagagcctcatgacaaggtgtaaagggtaagaataaacagaaagcaaaccacaacatgagacaggaaggtaggaggagaggggagtgccctgggtgactggggtggctgctgtgtgctgctgtgatacctgtttgcta

SEQ ID NO: 10010 - DNA, 1457 bp, Homo sapiens
gttccgcttcctcaagcacgagctcacgtccgagctgcgccgccggccctcgcaccgcgcgcgcaagccccccggggaccgcccgcccgccgccgggccactgcgcctcgaggcgcctgggccgctcaagcggacggtgctgaccgagagcggcagcggctcccggcccgcgccccccgccgtcgggtcggtgcccttgcccgtgccggtgccggtgccagtgcccgtgccggtgcctgtgcccgagcccggcctagctccccaggggccccccggccggaccgacggccgcgcggacaagagcaaagggcaggtggtgctggccacggccatcgagatctgcgtctgagtcgcctccgccgccctcggacccgggagcagcccgggcccgccccgagccggtgcccggtgcggcggtagggaatggagccacctcgccgcggggcagggggcgcagcggtagactaggcaggacgcggcccggcacctggtccgtccccggcgggctggtgagggggccaccaaagacccctagcgcggcctggtgagcgggggcttggcccagaggagccaagccgcacagacccgagaattcggaggccaccacacaacacacacacacacacacacacacacacacacacacacacacacacacacacacacgccaggagcaagggagctttcgggccacactcccagacgcctccctgagccctggaacccggactcgttgctcctggccttccataccccctggcagatcatcctgcggtcccaccccagatcccctcctcctcgccatcccattctgccccctccccaccctgggtacagaaagggactgaagtgttgggcagagagggggcttaaggcccctgggcacaggctgggatcagggcagtgagcgaagggcagctgtgtcctgccctcccttctggaggctggaggggagaggccaagcccttggaaaatgtagcaaatgtctggatgtcgcataagtgcgtgtatgtgcgggacaggccccgagaagctagtgactcctgcacacccccattgcacaaatgaaatcacagcccaggagggagggtagcttggcactggctgagaaatagagctctctccccgcccctccccctaaccacaagggattgtcctgacaacttgtggggatagaagggctcacagggcaggggtctcagctgcccccatccttagggcaggggagttagtgtggagccgagagcaggtcccagctccccctgccagccgcactgtcccaggcccagggacctctgccgggtcctcccagcccttgccacacagcctagacgtagtagcctgggcttccagcaggtggcgagctggttcgtgctggaaatttctcctgggtttcttggggtcaaacatgccaacctccaagaccccatcctcacgtctcccacttttctggcgct

SEQ ID NO: 10011 - DNA, 1119 bp, Homo sapiens
ctctctttctctctctccctctctctgttaagatcctgttcgggagtttccccagccgttgtagtatctagtatgttagagttgggaggggaccatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgtcgaagaaacaaaaaataatagcaaaaaataacactgtagacatgaagacttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatgaccactgggtggctgtcttttctcaagtttggggtggagagggcggtgggggtgggggcacacaggtactctagaaactgaaaacttgggctgggcggagcggctcacatctataatcccagcactttgggaggccgaggcgggcggatcacctgaggtcaggagttcaagactagcctggccaacatggtgaaacccccatctctactaaaaatataaaattagctgggcgcgatggcgcacgcctgtac

SEQ ID NO: 10012 - DNA, 1182 bp, Homo sapiens
gtagttatatgaacatttgagcctccaccactgcgcagactgccttcctggctccgtcctctgctttatttttcttctcagcatgagtcaccatccttgtagtgcagctctcttgcccaccacaccccacccctagacataagctccatgcagactggggacttgtctgttttgctctccctccccagcctagtgctcagcacatagtaggcacttgaagtagatttgtttagttttgtttttgttttttatctttagcgatggggtatctccatgttgctcaggcccatcttgaacccctgggctcaagtgatcctcccaccttagcctcccaaagtgctgggattacaggcgtgagccactgcacccggcttagttatggaataaatgaagacttgtcttgcagctgtcatctctgagtgcattatgaccctttgcccccagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtgagtgtggagctccagggttcagcaggctgccttgctccctgattacacataaggattaagagaagtgaagggagtaactctcccaccactcgactccatctgatttaatgacacctcctctgcctggcactgtgctaagtgttttacaaataattatttaatctgcattagtaataaccctatgccggtaggtactagtaataccctttttcccagtggagaaactgaggcacagagtagttaagtgacttgcccgagtttaatgcagctcatgtgtacctctgatctttctttcccttttcttcccttcatgtacattatattccagccaaaccaactatcatagagccttatcgttcaagaggctaacg

SEQ ID NO: 10013 - DNA, 1182 bp, Homo sapiens; identical to SEQ ID NO: 10012

SEQ ID NO: 10014 - DNA, 1141 bp, Homo sapiens
ctagacttttctgacgggtgcagaagagggacgggttgattggaatgagtggggacagatgggaaagcctggctgcccagctgagacaagggtgggtgctctccctgccagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaaggtgagcacgtggcagtcatggcagaggggaatgggtgtgtccacctgtcctccacttctgtcaggacttgacagcaaatctgttactctctagacttccgcaggtggagcagggagggaaactgaggtattagaatgagactggatagagtctcatctttagttgctagagcctgtgccttttaaagctggatctcctttgcaaataacctcccttcctccccagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcaggtaggatggggaggccttggaggtgaaggagtgccaggcccctggcctcttggcaaactggcttaaccagaacagccacctgtctggccggtgcaaatttaagtagacacttggtctttcccagttgccagcatcctgcagtcctcctgcatgtaaacacataatttcgtgtcaaaaaaaaaaattatccaggcttggtagtgcttgagcccaagaggcagaggttccagtgagccgaggttgtgccactgcactccagcctgggtaatggagcaagactgttcaaaaaaaaaaaaaagctgtgtctggaagtgtagatcatgtaaaagtatatttgaggcaactaggaaatgtttatgtgtagagcacctggtgaacctgtctggggg

SEQ ID NO: 10015 - DNA, 1141 bp, Homo sapiens; identical to SEQ ID NO: 10014

SEQ ID NO: 10016 - DNA, 1197 bp, Homo sapiens
tccgaaatgttgacttcaactatgctactaaaggtattgtcctaggctgttacctcagacctgctctgtgtgcatagaggacagagggtagtttgtgtgcaggtggaacatggtgatgtgtttggtttgtttttttgtttttgtttgtttgttttgctttaatgccttttttttcctgagcgaagtgggtggatttttcttcttaaaaatatgtcttgatgtctaatatataatgcgatgaattcctgtctgtgttgtggttcttcatattttctttgcttggtttttaacttcttttttctttggaatcatagtactgatagactttttatactcttcttctcttgcctccccaccccctggccatcctaacacacgggcacacgtactctggacttcttaaactttgttcctgaactacttacggagagtggggttgggggatattggaaagaagtctgtgaaatatagcctgactcctgatcttcacctctgcccccacagacaagttcaccgattcagccattgccatgaactcgaaagtgaatggggaacacaaagagaaggtgcttcagcgctgggaggggggtgacagcaacagcgacgactatgacctcgagtctgacatggtatagcctccttccctgagaacttgggagctggacagacagaatgggttgttgacagtgaggttcatttgagtggggagggaaatatttactgttgcccattgatggtagtcagataacaaatagaaaggtatagaaaatagcaaagtaaaaatatctattcttagctgggtgcagtggctcatgtttgtaatcccagcactttgggaggccaaggccggtgggtcacttgaggcaaggatttcgagaccagtctgggcaacatggtgaaaccctgtctcaacaagatatataaaagctatcaaggtttggtggcatgtacctgtagtcccagctacttgggaggctgaagtggaaggatcacttgagcccagggaggtcgaggctacagtgagctgtgatcataccactgcactccagcctgggtggaccgtgtcacacgcaacaaaaccaaaacatcaacttactctcttactatctataattaaccactcctagcatttgcatcacgttatttttcaacataacaaaaagtatagattaatgtgtaggcccatttctcttccca

SEQ ID NO: 10017 - DNA, 1191 bp, Homo sapiens
gctaactttttaaaacaggccgaggtaggcagattgcttgagcccaggagtttaagaccagcctgggcaacacggcaaaacccttctgcaaaaaataaaaagattagctaggcttgatggcgtgcacctgtactcccagctacttgcgaggctgaggtggggggaatcgcttgagcccaggaggctgaggttgcagtgagatggcatcacaccattgcactccagtctggggaacagagcgataccctgtctctaaataaataaatcaatagaagccatagaaaatttttagtttcttttgaattacaggaaattctgtcaactgagcttgccttgctgcgtagcttgagttgactggaacagaatccctgccactcctttaagcattccagttgtcgatgatgcccatgaggccatttacctgcttgtgttacctgccttgagcttctagacatttaagttggtgactctggttgtatagtgtgtaaactttcttgctgttttgagtaaggcccttgtactcactgctgttgaccagcagtaaccatcctacagctcccccttttcttccagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatggtaagagctaggtgtttgagtgctgtgaatgcatatttagtgtgatttgtggttctggacagaaggacctttaggcatttctctttacttgaacagtaaaagaactctctaccaaggaacctgggagaactctggagccccaggagctggctcggatagctgggaaaggtgagggtggttttttttctgctgaggattaatgctcctttgtctgggggagagtatttcagttaggaagtttgttggaattcagaggcaaacaatgtctatcagtccttggattataatttcacttctgtgatcctcaagagtttctcttttttctttgctttcttgtcctctgttcttttggcactgtgtagccaccttagagaaagaatgttttgtattttcttctttttgactgttttctcatagtccctg

SEQ ID NO: 10018 - DNA, 1181 bp, Homo sapiens
gtgcagaatatgtttggtatgcagcatttcacgaatgttaattattaccactctaggcatggccaggagtagaggggaaaatacaaaataaaattgtcctcccttgtttttgcagaataaatccaccagtaccccaacttctccggggccccggactcattcaactccctccatcccggtgctgacagcaggccagagtgggctatacagcccccagtacatctcctacatacctcagatccacatgggaccagctgtgcaggtatgcagagagactggccgggcccagggttagcggggtgggatttggttgcgctggttgagggaccaggtcaggcctgtctgggcattcgtgagcgagtcattcagcctcatctgtgtcctcatccccaggcacctcagatgtatccatatcctgtatccaattcagtgcctgggcagcagggcaagtaccggggagcaaaaggtgagcagggctgggaggggcaggcggcgaggctgccaagggcctactggcaggtggagcttgagctctcctctcctcctcctcttccaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacaggtgactgcggcccaggagggcagtgaggatccagggcccctgctagggatcccatcttctccagagacttgggagctggctaggggtggcaggcagtgttgtaggtgggatcggccctctgtggtattggcggtgtcagacttgggcttgagccctggctctggtggtacctgtaacaaggcattggacatctgtatctctgaagtgtagagaaaatagtgtctgctgggtgggatcgttatgaatgttgaatcaatagggtgattgtgaggaggcccaagcggtgctgtgcacgcagtgactggcaggaggacaccttcccagctggcggctgtgccaaccactcctctctctgtcccgccagccggtgtttgcccccatgcttcagagcaacccacgcatgctgacgtcgggcagccatccccaggccatcgtgt

SEQ ID NO: 10019 - DNA, 1617 bp, Homo sapiens
cttcccggctacttttttgttttccacaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaacctgcctggagtttcctccttggagactagagtggggtgacagctgtcagtcttttgtggcattgataggtgctgcattgtgacctgttccttcacctccatgtaaaaatcgtgtccagtggccagccatggtggctcacgcctgtaatcccagcactttgggaggctgaggtgggcagatcaccaggtcaagagatggagaccatcctggccaacttggtgaaaccccatctgtactaaaaatacaaaaattagccagatgtggtgggacatgcctgtaatt

SEQ ID NO: 10020 - DNA, 1158 bp, Homo sapiens
tttgcctcctacctcacctcccccatcccgccctcagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggtgtgtgtgccagaaagatggggcggggaggggggactatcacaaggagaagctttgcttgggagagcagggtagaggaggctgttgtgcctcggggtttggaagggaaagaaatgcgctgataggacacaggaaggcagaaggctcctggccggagccggggcggcagctgagaggtgggcgggcgcatccccattccatcggatcctctgttccattgtctgtctgtctcctggacccatcctggcctcgtctttgccctccgtcgcagcctggccttgggcctgcccttcccggggacactcggtctgatccccttccctcctccctcaatgtctcatgtccctgtctgatctctccctttcccctgccccaccgtcccatctgtccccacgttgcccctccccccaggccgggagcaggctgggagccatgcgggggtgtgcgagggagatggatgccaccccgatgcctcctgcaccctcatgcccttcggagcgagtgactgtgtgtaagtgtggtcctcctctcaccaccgcccatgatccatcttccatggatggggggttgctcaggagatgggatgtggggagacagccacgctcctggggggctgagtgaaggggaggccacggcaggagctcacctgcctccacaatcagtctgttttcttaccattcctatccagaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggt

SEQ ID NO: 10021 - DNA, 1865 bp, Homo sapiens
ggcccccgtcctctacctgagcaacttggagcccagagggatgacaggattcgtcccagctcccagagaggagcctggctgggctggcttctttgtcctctctcctttccccgcatggggccctgactttattgtttccgcccctgccgccatcctccctgtcccaagttcctcgtctatccctacgggatccccgccccctttcatgttctgacgtccattttcttttgtctccatccaggattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttc

SEQ ID NO: 10022 - DNA, 1085 bp, Homo sapiens
gtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaaaaaaaaaatgagctaggtgtggtggcaggcgcctgtaatcccagttacttcgggaggctgaggcaggagaatcgcttgaacccaggaggcagaggttgcagtgagccaagatcgcgccattgcactccagcctgggcgacaagagtggaaactctgtctcaaaaaaaaaaaaaaaaattcagtgaaatacacctttatatatgagatccaagttt

SEQ ID NO: 10023 - DNA, 1115 bp, Homo sapiens
caggggcgtgccctccctggttcatccatgaggctgactcccctggctttcctgtctcctctccctgcagatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggtcagttaggagctgtgcccggcccagcttcttgatctgcctgtctgtctgtccatctgtctgcccactcctgtgcacctggcagctcagtccacagccctccccttgtttggcctccagtctgtctgcatccacccctggggtggctctgtggctgccccatccatttcccgctgcctgtttgcccttctctggctttgtctgtctgtccatccagctcaccctggctctgaccctcccccctcaggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagaccccaggtgcctgctctcgtctttctctgggtggcctctgatcttgcaccccgtcttcaccccagggctcctgaagactgtgggtcattcctcagggctctgggtgagtctctgcccttctgggctgggcgactgagatgggggactgctcttctccgagtgagctggctgagtgtgaccgtgagtcacgcccctgcttccctggagcctgtcccttgcctcacaggcctggctgaggtgggggtgggcactgccctttgtaccccagaattcccactgtcagggcc

SEQ ID NO: 10024 - DNA, 1115 bp, Homo sapiens; identical to SEQ ID NO: 10023

SEQ ID NO: 10025 - DNA, 1153 bp, Homo sapiens
acctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccgcctcggggtgggccgcgagcaaggcaggcgactccactgggcgccatcttcggggaacgactcagcgcag

SEQ ID NO: 10026 - DNA, 1830 bp, Homo sapiens
atgcagacccatctggggggggccgccccccctgtcccgggagacgccccccagccacagcccacctgctgagggggacccccgcacccaccaggcaaggcgtggggcatggctggggggcgggatggggggtgtgggggacaacggggctcaaagggcccaataggggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaatgaattgccctcactaagaactgccgccaaccccaagggtttcttctcggcctggtgtccgtcaatccagccttgctctgccctgtgaggctgtgaggttctggctccgccctccccaggggcagccttactggcggcagcacagatacagggcggggccaaggctgtggctgtggagagcaagttccaggtctctggggaattcccaactcggacaggcccagaatagcccctggaggtttgaagaggccccgtcagaaacccaaacagagctgccagacgggaatgccgccctcccccgtccacactcatggccg

SEQ ID NO: 10027 - DNA, 1139 bp, Homo sapiens
tcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagct

SEQ ID NO: 10028 - DNA, 1223 bp, Homo sapiens
gggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatgagttggtttctcagagtgtggtccttagaccacctgtggtatatttctatttctcttttttgcttttctttctttttttttttttttttttttagagacagagtcctactctgtcgtccaagctggagtgcagtggtgcaatcatagctcactgcagccccaaactcctgacctcaagtgatcctcccaccttagcctctcaaagtgctgggattacaggcatgagccacaaagcctggctggatatttctttaaaatgcaaattcaagccaggtgtggtggctcatgcctgtaatcccagcattttggaaggccaaggttgggtggatttagtacaggagttcgaggccagcctgaccaacatggtgaaaccccatctctacaaaaaataacaaaaatagccaaatgtggtggcacatgcctgtggtcccagctactcaggaggctgaggtgggaggatggcttgagcctgggaggcaggagggagaggttgcagtgatccgtaatggtgccactccag

SEQ ID NO: 10029 - DNA, 1185 bp, Homo sapiens
ggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccc

SEQ ID NO: 10030 - DNA, 1183 bp, Homo sapiens
ccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacagatctcaggactcacccttctgtctttggtgtgcgtgaaggactgctcagtggccactgaatagtactgcttgtgttttataaagagaatttattgggctgtgtatctaaacatttcagtgattttaatgactttaggtgtgaccagatctcggatctcaaaggtggtcttcaaccccttgacctctaattcgttttctttgctttgacttcaaagattcttaggtttgcctcccacacagaccccaggcagctccatgctcacgaatcttcccgcaagcctcagcagccagagttcagtggagacctcatgtgactgcagaggctgggcctgtagccagaggcctagagggctaggactggcccaggaggtatgggcttttccccacccctttgaggctaacagcccatggacaaagtggctgtttgcataagggagaaggcttaagcactggctgccctcaagtcattctatcc

SEQ ID NO: 10031 - DNA, 1234 bp, Homo sapiens
ctgccgtgcggaggagctggatctgggagaggctgcgggcagggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgcctctggcttaacccctgtctcagggcagcccaggcgcctccctggagagggcaggtgcccgggcctttccctcccggtttcctgtgagacacccccatcccctcatctcacctctatcaccacccccaggcacttgctggtttgaggctctcgaggggctgaggggggcaggccctgagtgcagcatgggttggcccagctgtgcccagggcctcttccccctccccagagctgccctggggggcaaagcctagtctcctgaggccccagtgcctccctgactagtccccctgtgtttcttccccctgctgcagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtttgttttttgtcctttttttttg

SEQ ID NO: 10032 - DNA, 1140 bp, Homo sapiens
ctccctgttgggggagagggacggggcagcgtggagaggcaggagtgaggagcgcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagcaggtgggcagggtcagggccacctccctgccacttgcccgccctcaacacccgcagccagctcctccctcaccaatgaagtcattggatttgccaatgtcatagtcccagacggtgacttccagggtcttggtggccagagtggagagctctatctcgtagaaaaactcctagggacaaggccggccacccgttcgtgagccagctccccagcccctccctggcctccctccatgtcccgtcccctcctgggtacctcgttaaattctgggttgagagtcttcttcttcacacacgtcttatgcttggatttcttgtccacatcgggcctcaggtacctgggggtggggtggagggagacgaactgaggggtgagggacaggccaggcccaactcaggccagggcaggctccctggggaggagagggtcagagcaagggctcacgtcttgacgtaggggtccgagtaaccgttgacgtccatggcagccagatgggcgcagcgcaagatgcctaccagcagtccccggcgccgcgagctgtagctgagactcagcaggatgcggccacgctcctccagcagcccctgcccctgctccgcctgctccaactgcggggcacagactcagggtcagcctgggcccctgcagcctccc

SEQ ID NO: 10033 - DNA, 1447 bp, Homo sapiens
tcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgc

SEQ ID NO: 10034 - DNA, 2089 bp, Homo sapiens
agctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggtagcagagcccagaagaagaaagagcccctgttctctgttttttctgggcagaaaaggagtgaaaggtggaaggaccttcctgctctgttttatacttggccagggcttcaagaaaggctgagagcttgtgacattttcttccagccactgcaggctctgccccttcacctaacagcataagatagggctaacagttggggagtatggttgtaactgctcatgtcttaggaggcttcagcctcagcacttttaggtccagaactcaaggggggcagaagacccctgtgacaaaaacccactaactagctcatgagtgacatgagccaggcaacataatgggtgttttatatgagtagatgctgttatttttaatttatacctaaggctcttttgcccaagattgaactgtttcttggtggaaaggattatcaatgcatatctcttttttttttttttttgagacaatctcactctgtcacccagact

SEQ ID NO: 10035 - DNA, 1372 bp, Homo sapiens
tgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggcctagagggccagtggattttgtgctaggtcaggcagctggaaacacaggtctagatctgggcctgggtctcctagcaaagcctttgctcacccagccccgcccagggccaaacacaggagcccaa

SEQ ID NO: 10036 - DNA, 1125 bp, Homo sapiens
cctgtcccctcctcccccagggtctggggcttccagtgaccagtagaagaagccttgggcaggagaacattgcaagcaaagggaacagtggaggcaaagacaagggggcgtgactgcttaggctgcagaggccttgagcgccgagcttagcagctaggtctgattccagatttgtgatttcggcctggcccggattgccgatcctgagcatgaccacaccggcttcctgacggagtatgtggctacgcgctggtaccgggccccagagatcatgctgaactccaaggtaggaggggctgcccactcctgaaaggaacggaccagttcccaggaagccctggagctacctctgagccagacactgacccccatgacacaggaattctaccctctgggccttgggctctgcaaggaagctgagcattgagccctccaggcctctgccttctgcctggtgttggatctaacttggaggtggtggcctggcgcagacaacaggaccctgttgaggctggcccaggagctcaccacttcctcctctcccccagggctataccaagtccatcgacatctggtctgtgggctgcattctggctgagatgctctctaaccggcccatcttccctggcaagcactacctggatcagctcaaccacattctgggtgagggaggcccggctggctgagttggggatgattagcttttccgaggtgagatttctcgagagtccaagtcagggataccaccacgtgtggggtgcctccagcatctcatggtatctcaatgaggtatagatattatccccattggatagatgggaaaagcaaggctaagtcccacacctgaggaggcaccagacctaggatttgagcctcggtctgcctgaacccagcccccttgctctgcaccaccatgctaatgactaggaggtgactgagggattggcatgggttgctgggctggggggtcttgttcttgccttgttgcctattctgttcccagaaagaaagaggtgatcatttaccaagtcacctccttatccacaggcatcctgggctccccatcccaggaggacctgaattgtatcatcaacatgaaggcccgaaactacctacagtctctgc

SEQ ID NO: 10037 - DNA, 1258 bp, Homo sapiens
gaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacacaggtaaggccctgggagcaccttgcctagctcctgtaccacaaccccagccactccccctacccctgcaacctgactcccgcactccccctggcgtggctcagggaccttgaggatcccgccttcgtgacccctgcttcgagtatttcgatgtagaccctctctccaagtacgtgttcccacggcctggggactacaaccttggggacaccagtctcttgggtcaccctagcctcggggtgtgcgatcaccgctggccttttcctaaccccatctctcgccccaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctgaggccgagtctaggacctggcctctccctgccctgcctccgtccattgttttaccttggacacgtctctgtccccatctaggcctctatccctgcttgtaaaatgaaagttctaccgtaaaagtcccttccagggtctaccgagaaagccttctctctgcaactccgtttagacatctaggagtctgtactgccaccacctacccacctcctagagagctcagggttcctcctctctgctagccttcaagatgcagagatgagaaagtgatcggggtttcagggccctgaccagttgaacaaacctctccctgacattaccgcagtatcagaggcaccatatagaattccacatattccttgcaggttccccccggccttctcaggcccaagagggagtggtgcccaggtaggggctcatcaactcctggaatgctgatgttttcagacccactggagaaggttccagtggccccatagccctgggcttaatgtgtctacagctgcccccggaggaccatggaggttttaagaatagtgggtgtgggacggggataggggtgagattagagtaggaatataaggctgacctgagtcagaaaattggggcaggtgatgcccctgtatcagtcttcataacaggttag

SEQ ID NO: 10038 - DNA, 1258 bp, Homo sapiens; identical to SEQ ID NO: 10037

SEQ ID NO: 10039 - DNA, 1435 bp, Homo sapiens
gagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgggcctgttttctgccttgttatttgatgagggggggatggggtaaggacgagggagggagggacagagccaggacctgggtctctgttgaagcagtctgctgtcttggcaagtaggtacctcttagctttgggtccatctctcagtcactcatcagacactggttgagctcctgctccatctttgcctgggatctgctgtctccattgtcactggctgcctggagctctctatgtaccacgtgcagcacccggatctccttcccaaagtgctcatgcaactcctggaagctggagggggtactcacagtggctagaaagccactgtcctctggggatgagatgggttcttggccagttgcctggcacagctcccagtattgggttttggtggggggggaggggggacagcagcccagccagccgcctccagctcgcgccagccagtg

SEQ ID NO: 10040 - DNA, 1158 bp, Homo sapiens
aaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtgcacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccacccccacctcctctgggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgt

SEQ ID NO: 10041 - DNA, 1231 bp, Homo sapiens
cgaacctgcggcagcaccggcggcggcacacgggcgagaagccgtacgcatgcgcgcactgcggccgccgcttcgcgcagagctccaactacgcacagcacctgcgcgtgcacacgggcgagaagccgtacgcgtgcccggactgcggacgcgcctttggcggcagctcgtgcctggcgcgccaccgacgcacgcacacgggcgagcggccctacgcttgcgccgactgcggcacgcgcttcgctcagagctcggcgctggccaagcaccggcgcgtgcacacgggcgagaagccgcaccgctgcgctgtgtgtggccgtcgcttcggccaccgctccaacctggcggagcacgcgcgcacgcacacaggcgagcggccctacccctgcgccgagtgcggccgccgcttccgcctaagctcgcacttcattcgccaccgacgcgcgcacatgcggcgccgcctgtatatttgcgccggctgcggcagggacttcaagctgccccctggcgccacggccgccactgccaccgagcgttgcccggagtgtgagggcagctgagtcccgcagggctgcggaggggcgcgctggggcttcgacctggctgcactaacccaggctcctcctcgccccggcctccgggtctgggaaattgaggggacggcaggcccggctgccctggaactgggagacagggagaatcccctgccggggtccctggaaacagtgcccaccccacatcactacattccctcggcccgtgttagtgaataaagtattatatcctcaccccacccgtgcctgtgagtgaggtgggtgggagaggaagaaagttggggttctccaggctcaggtgccaagtgagttgtcaaggaaccaaatggggatgtaaacctaaaaggggttcccggcacctcggtttgtgttggttggaggtgatcgcacacttggcccttggttacgtcctcataaccttagacctgaaagggcccataaatatactatgttcacgatcagacacgcactgcattcggcagagctccagtgagcaaggcacgaccctcagatctcagtctagtgaaggagagaaaactgtaataacactacgttaaaggttttaactgctttgttatgtaagcttacccagcccggcgcacagtgactcacgcctgtaatcccagcactttgggagggcgaggctagcagatcacttgaggttaggagttcgatac

SEQ ID NO: 10042 - DNA, 2208 bp, Homo sapiens
gccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaactattctggctaatgtttggtggtttgaaattcaatacagtcttataaaacgaaccagcttatacactgagtctggtatagcagagagagagtgttttccctgatgctggtgaattgggtaatttaacacccagatttagggttgcaccttccccctgaaatgacagaaaaggactcgaagcaggcatacgccccaagggttagagagtgggcaggaaatagcaaaagaaaggtgtcaacaattcttgaaagatggaaaggaggtggaagaggggtaactgacttaaaggaatccttcatagtaggggaagacaagaagcaagaagatgtgcttggaagatggggtaagacctggggataaaacatactgtttgagagtttatacacggtaattcgatctttagcgttctccacactcttatttcacacagccaggtga

SEQ ID NO: 10043 - DNA, 1179 bp, Homo sapiens
agtgacatgggctcaggcccccactagtctcttctacccgatctgaatgcctaccttggtctcaggttctgaaagcacctggtcctttgaggctcttggctccttccctttggttgaacccaacctgccaagaaggtcaaggctcagggacaaacaggattcactgcattatcccccgtctcctgcccactggatactcagggaaggaggctgggaccaggctgcagccaggcttcaagggggttttttgagagcactacctgggttctgctggttcggagaaggaagtggatgccgtggacgagcaagatgtggtgagagaaggggaggctcccactcctccgagagggaagacctctttccggagacagggccgagggggtggcggggctcgggccatttccccaccacccacagtgtgccgccgcggccgtggtcggcttggttggggtggagcaggtggccaggtgcaggtacctgggccagggggccccagatcagggcaggagtagcttcggcccagagagggcttagggagaagtgctggggtattgtggtcctgagttcgccactggcggattgggggccgggggctgacagacgcagtgccctcagcagccccagactgctcggcctctgagatggcgatcttcaactccagcttcattgggggggacgggggtgggggctgtggggttttgttgggcgtgaggaagatgtcagcaaagctctccagcttggagcggacggaacggaagagcggggccaagccccagggactgaggcgggggcgtaaaaggctggacggtggtggggtggatgggagctccagagcaggatctggggctgaggaaaggagagggtcacaggtggatattccttggctgcagtgtctcagcccctccccacatgctcaactttgtgcacaggggaattagcccacccttaaaacactaagttctgcatttaagaattgaacttcaagcctctgacatcaacatcccatctttatataccaagccctgccctgggaggtggcttaagccctatccccaactctgtacctgacacttccaagctcaactaggatgtcccagacacccaagtctcatccgatctctacccaagtccttacctgttggtgggctctccagagggtctgcaggcagagcagatggc

SEQ ID NO: 10044 - DNA, 1153 bp, Homo sapiens
gcatgctccctttgtgcttcctttagaccatagtgagcccctaaggttatttagttttactttcctaagaggccagcccaggatctggttaaagaaggtctccctaaacatcgggtaaaagtacataaataaaatggttatcttggtgagcagtccctttcacatctgtggcaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaaggtgtgtgttctctttggtcctgttactcttcctcatgtaccctttccagagctgaaaaacccaccctgtggcttgcagggcccgtggactttgtgaccttgttctcctgctatagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggaggtataggcagaaggagcagagggagggttcagagggggaacagagggagaggttcagggtctgagttccgggctgtgaggttggttatgagttttaggagttctgctagtaatggacatttgggctctttggggatgactggggaagaatctgtttggggcaagttgcattttgtgattggcaggttttggcgctatagtggaagagcgtattgcactttcctctttaaattgctgtgtggtcttgaaaaagtacttcctctgaccgttacttgccacttctctgaacatgccctaatgttcccttattggcttacaggttggaagctggcatggtacccttaagtcttttctgtttctccat

SEQ ID NO: 10045 - DNA, 1134 bp, Homo sapiens
taccctttagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtatccccaggttctggcctctcctttctcatgtcttgactttctcatgtccccacaacaaatgcctcatttccattgtgttacctatatttcctctctgacaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaagtaggcaaggccccttcttttgttccccctagtctagctccctgggagcttgttcagtgatgactccagcttcattgacttttgctttattgactccggtcattaactgtatagagaggacagtgtaggtgctaggattcctaggaagggccaaagggtggccagggttataactgagaaatcagaaccacagaatttacatttccttaccatctctgatttttttgcctaacaggtaactggggtccccatttaatcattgttcccaccagcgtgatgttgaactgggagatggagttgaaacggtggtgccccagctttaaaatcctcacttactatggagcccagaaagagaggaagctcaagcggcaggttcgatgtttcatgtggtcactttcctcccattgatgcctcctttatttttaagccctttcctcaggtgaattcctttctctcctctttcttttttaaaaaaaattttttaattttttgtaaaaataaagatggggtctcac

SEQ ID NO: 10046 - DNA, 1105 bp, Homo sapiens
ttccttatatcacttcctgtgtcatggtatcattttgtgtctgtctccttcagcagacagcagatcccttgagggcttgcagttgactcatctttgtgtggttggtgtctgatatggtgtgccgtatgactccattagtgtttgctgaggggcttaggctggggctcggtgcctgagttctcctgtttagcctccagcttaatttgcttttaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacgtaagggaggaaggagggtgggccctgggactcgagattggagtgtaggtggctgttaggacgtctcatttatttttcctctttccccagaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccaggtaagtatgattccattaatatgaaatgtaaaggttatcggcattactccaaccatgtacctcttttcgttagactggggtctgacttttgcatcctcatgactcccctatcattcccttagttttattgtactctagccatgtgacttaacgatggttcaacttaatatttttttgacttcactgtgaatttatcaggatgtaaccccatcgtaaattgaggagcatctggacttagaatgattcagcttacaattttttactttttgatgggcttatcaagggtattaaagggtattaaattctttacttgctgagggtttgttggaatgtaacctcattgtaagtccaggagcgtctgcatcacattttgtttatccacttatctgtcagtgggcacttggattctttccaccttttgtctcttgtgaataaggctatgaacataggtgtacaaatatctctgctttttattttg

SEQ ID NO: 10047 - DNA, 1144 bp, Homo sapiens
atggttcctagaataagtggctgaaagctgcccagaggggcctggggtgggaagaaaagagttggatgcaaggctggaatatttatatgggatgggtgcaaacgtggagggaatcagggagagaataactagaagagggtactgggatgggcttctgtgttagtcactttttctccctttctctctgttcggtgctttctgattgtcttaaattcctattccttgttctcctttgggtctctttccttttctttgcttttataatctgtctctctgtttcattttcttcttttctttgatattgctaccccttattctccttctgtccctacccactctcttaattttttctcacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccagggtgagttgaaagggagccaaggatgatgcgtggtgcttcagaaaggttgttcagactgaggaggaagtagtgaaattaaagggtttgaggagctgggctggggacacgggtctagtatttgatgggttggaagggagtatggaggcttctggcaccaggctaaggctttagtcagggtatatctgacaggtgtttgctttgtgtctgcagtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctgtaagttcccagggctctgtggt

SEQ ID NO: 10048 - DNA, 1163 bp, Homo sapiens
gatgaataaatagtggtaagcctagcagtagaaaagtattggggtaaaaggacagtgtagagcagatggtggtgattagctcagtctggtggcaggccatgttagaggatataaaagagattgctaagcaaatgggattggaaggagtagcacatgaaaagctcaaaggctgtaggtggaggctgagtttattgggacatggtaaattgtgggaagggcttagttgtttgaactggacactcgggggagaggtgtgcttcatggggtctgtgaagtggtgttgagcaggatgagccttgtgtacaataaggccttctctgtttttagcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaagtaggtaaaacccaccccctgtcctgcctttttcctcctcttccctgtctctttgtttttgtgacttttttgaatgtcagcctttatgtttcttacccaagcttttggtgggtggggccaacgggcatggttggagggatcttggataaagatagggaagaggtcattctagagaatgtattccctctctgttcttttcttctcttcttgccttgcctctgccctcctcaggctgatagctgcttctctctctctttctctcttcccttaacccagggaatgtggtgcacctcgtgtcagcaggggggcagcaccatctcatcagccagcctgcccatgtggccctcatccaggccgtggccccgacccctggccctacccctgtctctgtgctgccttcttcgacccccagcaccacccctgcccctactggcctcagccttccgcttgctgctaaccagggtgaggctcctggccttcctacttagcccttgctggccttggtccttccaggcatgcgctgggctactgtctgtccagccttccctcagtgttgttttcccttgcgaatatctatgatacctgtctgccaccttctcctgcccctggacttcttccattctttgggtcttttgtttcttttctaccttcctctcagtgtagcttcctct

SEQ ID NO: 10049 - DNA, 1669 bp, Homo sapiens
gagtgatgagactcggatgtccggttagctgttcccattccaccccattccagtctggcccttggcaaaaacctggtctggatttgattggcgcctctgtatcctggtcagtgatttgaagaaggctatagtcctggagttgagtgttacgtaggaaaatacccacaaatcgtccattctataaacttgttggaattgtagatcttaattttgaatattcagtcattctgctttggtagcatacaaggaaagatcagttttctctaggagagaagttacttaacataacttctgagaaagaatagttatttaacataaaaaagaaagttatttaacataacttctgagaaagaatagttctcattgataacttggaaaactacaaaaagcatagtgtatttttggatcccatggtttctatatatttatttccatctgggaagaacagtcaggttttgatgtggactctgagggtgctgattacttcctctttttctctcacccccaggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttggcagggctaagtgctaatggggagtgggtcttggggcctcagagtggatgtagtgcttagggctggtgaaggtgttaacttctggggcatttcagagtcccatcttttacactgcctgcttcttcctttcacaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggtgagtttgttggccagtgtaggacccttgacttctcttcttttcttagtattaagactgttgtatcagagggatgctgcacttaagttctcttgcgatttctgtaaagctttagatggttttttaggttatgcttatgggcaagatagagaaatgtaagccttgttagattcttgacattcataaatatgactttcttctttttttttattttgagacaaagtctcgctcagtcgcccaggctggagtgcagtgcagtggtgcagtctcagctcactgcagcctcccaggttcaagtggttgtcccacctcagcctccagaatagctgtgattacagacatacgccaccatgcctggctaatttttgtatttttagtagagatgggatttcgccatgttggccaggttggtctcgaactactgacctcaagcgatcctcccgcctcagcctccaaagtgctgggatcacaggcatgagccaccatgcccggccatgaatttgactttcatgaaagttgaaaatgtgctgctaactccttcattcagtgatcat

SEQ ID NO: 10050 - DNA, 1158 bp, Homo sapiens
taggctggagcagaccgaagaggtgaagcccttaaaggaagaacttgtatggagttaaacgtagatagatattttttgtgacagggtctcgctttgttgcccaggctgaagtgcattggtgggatctcagctcactgcaacctctgcctcctgggttcaagcccgagttctcatgcctcagcctcctgagtagctgggattacagtcacccgccatcacgcccagctaatttttgtgtttttagtagagacagggtctcatcatgttggccaggctggtcttgaactcccgacttaaagtgatccacctgcctcagcttctcagagtgcagggactacaggtgtgagccaccatgccctgccgtagttaaacatttttgatctgctaggctaattgaaactttggcttaaagcattgattatctttcaaccccagccttgcattgctaagcattctacccattgcggcttgtagctagctccctgtatcccttcatatctctttaggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggtaacccaggtttctgcagctcttagaggctcacctccgcttctctctccttttcccaggatttgggcttccagacggggtgccactaagcctttagacctgttttgggggataagtctcccagtatcatctttttttccctttccttctaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggtattgcctagtcttccctcaccttactttccgtttactgatggggtttcctggatatatttggctgcttacacacggccttcatcaccccctaggcttatcagtgaacggacagtggaggagaacatcctaa

SEQ ID NO: 10051 - DNA, 1105 bp, Homo sapiens
gtactaagtaagatcttttagcctatgcaggagaaaactgctgcgccttcaggagttcctcctgtttattaaagaagactgctttggactttgggaggctgaggcaggcggatcacttgaggccaggagttggagaccaggctggccaacatgatgaaaccctgtctctactaaaaatacaaaaattagccgggcatggtggtgggcgcctgtaatcccagctgcttggaaggctgaggcaggagaatcacttgaacctaagaggcggaggttgcagtgagttgagatggcgccattgcactttagcctgggtgacgagcaaaaccgtctcaaaaaagaaaaaacaaaaaggactgctttggccttcacagacgtgcgtcttcaaccagtggtacccctgacagttccaagaaccatcagccttacagcttagacctaagactagcattctgttgactctgacacttccctctgttctatccgatagcagaccatccgagagctgtttgatatgcccctggaggaaccttctagctcatccgtgccctctgcccctgaagaggaggaagagactgtggccagcaagcagactcatattctggagcaggtaaaaaaagagtgggcagttcgtaaagttgagctgattcttacagaatatcttgtcttttgttagtctgttgagcttgtccaggggaaagagatgtttcttctgcttcccagattacagtcagcctttgatagttgtaagcacattgcttattggttcacatgattaagtaggaaaaaaaaacaggattttggagtctttagttttaggtttgaattccagtaatgcttcttaattgtgttaagacaagttacaatcgtcactcttctgaacctcactttctattaaaagtaatgtgggcagggcatggtgggtagctcatgcctgtaatcccagcactttgggaggctgaggctcccagctggagagctctgaaaacacacaaatgctcagacccaacaccccaaaattatgatagattttgagacagggtcaaggaataaatcttttaagaacctttccaaatgtgattttattatgtgtaagtatttgaaacag

SEQ ID NO: 10052 - DNA, 2158 bp, Homo sapiens
acaatctcgggtcactgcagtctccgcctcccgggttcaagcagttctcctgcatcagcctcccgagaagctgggattacaggcgtgcaccaccacgcccggctaatttttgtatttttagtagagacgggggtttcaccatgttggccaggctggtcttgaactcctgacctcaggtgacctgctggccttaacttccccaagtgctggaattacaggcgtgagccaccgcgcctgacctggaagctgctaatttctactcactctctactctgcttgcctcctcctgaccacttttggaccctgttgttgtaggagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatcc

SEQ ID NO: 10053 - DNA, 1102 bp, Homo sapiens
gcagatcctgatgttacgcatgatcatggagggccagtaccagttcagttcccccgagtgggatgaccgttccagcactgtcaaagacctggtgagcgggggctgagaggacagtaggggaggcccaagagctgcccctcatgctctgggtctctcctagatctccaggctgctgcaggtggatcctgaggcacgcctgacagctgagcaggccctacagcaccccttctttgagcgttgtgaaggcagccaaccctggaacctcaccccccgccagcggttccgggtaagcctgagtgtatcagggtctgggcccgtttctctgtcccatgatctttcccctgcactagagctcaccctgccccccttcccaggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccagggagaacaggtgtcctgtgtctgtctggcttgggcaggaaagcccagaaggtgctcagcagggtgcagggatggtgccattctggcccagacctttattggggaaaatgttgggggtcacttggtcttgctcttgcctttacccggaggtagctggaagggccgctctagtg

SEQ ID NO: 10054 - DNA, 1231 bp, Homo sapiens
acttgttgagtagatttttgaacacttagtgctaggcactaggcatattggcgagaacaaaatagaggtcaaaactttcatggaccagacaagaaataaataaaagaatatatctttaggttctacttgtggtaacagacaagaaatcagtaaaatagcatatcagtgtgttatgagtaccacaaagataaagcacagaagagagagctaagagtgagttggagtcagttggcatctggtggtcactgtgccctttttccctttattagcactttaggcctttctggaatgccttccgtgactccccatcagttaagagccttagttcccagcaccgaccatgcagtattgaattttctcccatttttctgggagcccttaggaaagtacttggtttggggtgtcagaatcgatcattgccctgcacggggtgcttggggtggagtgtatgctggggatgtaagggaggcctgctgccacgtctggccctgcctcccatggccctgcctcccactccttagtttgagatgctgaatgcagagttagaggaaaaccaggaactggccaacagccgtatggcagagctggagaaactgcaggccgaacttcagggggctgtgcggaccaatgagcgcctcaaggtgggctgctgtaggggctgagaggtcctgggcctgtaagggagggactgagccctgaatcctgttgctgatcccatttgggcatccctgccccaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggaggtatggccctggaacaggcgttagggctgggctaagggccaaaccgttagtgttgacgtgtttgtgccttccgaggccctgtgtgccagccaggggtccctggggaatagattcttcctaagatactgagtcctgaggtgggaccgaggggctgtgtgggtccttaacacatcaacccacagagcgacgagctggggctgcagaagaagctacgcacagaggtcattcagctggaggacacgctggcccaggtacgcaaggagtatgagatgctgcgcatcgagtttgagcagaatctggcggccaacgagcag

SEQ ID NO: 10055 - DNA, 1191 bp, Homo sapiens
cctcagtttgctcattcatagagtgctcgtccttacctccagggttatgggaggatgaggtgcagtctccagtgtggtgggcttggcctggactcctcctgctgtcagcttggggtctgggcactgtcagagttgttcccaagctgatgcctttgcctggcccaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgg

SEQ ID NO: 10056 - DNA, 1226 bp, Homo sapiens
tgggcacctcgcccgcctgtggtctcgaaatcccccccaccagtggcgcacggcctgacgggagttgcagtctcccggctcccgtctatcatctcaagtcgagacaatggaaggggatggggcggggccaccggcaaagatggcggctgcagggccggggcgactgcgacatgggatgtgtagtccaggcgtctggcctcttccctgcggaaatgagggagaggactacgaaaaagatggcgacctcgcccctcgacctctgcgccggtgcctgctgggaaatgtagttccttgccgagtccaacagagaaaggacgtcgctgttgaaatgtgaatcccggcggacacgccaaattgcgaggcgacggaaacggaaagactcttttctcctctctccgccaccggcttctgaacagcctggcgggaaatgtagtcccaagctttcactcgcgagtggaggggaaggatttatgtcaccagtggggatcagtgcgggtgggggagaaaaacgtcgggcgatccgggaataaagaatgtccgcctctccatggggcgaggacttcgcgtttcaggggagggcccttaaaggaaggcagcaggaatcagtcttgtcgaacaggggggcgtggttctcgtcgagagtgcattcacactcttgttccctagaaagcctgggcacctcccactcgattcctgctcctcagacctccgggaatcagtgtcttacaagacgtgcgggctccggggaaaaggacctggagtcacagcgaatccccgccccgccccgggaagccaccaaaccttgctttttctcatctgcaaaatggggacaatggggataatgatccccacctcgaagcacagttgtgagtgttaaacaagccaatgttcttgtcaccaaagtgcccaactctggcacggggcacgcggtggtagatccctttctaaggtcccttccagcccagccgttctgggagcccaggaatccatgatgccggacagagttcgctcctgtgagaagaaaactgacccgcaggctcctcccagattgaaccgacccccgcccctcctcatcggggtcctccagcgtctgttaccgagcactgctcccagggggcgctcaatctccattcgactgaggtactacaaacacgatttccgcaacctggagttggaggcattgcaggctgtccagcctcatcccctgcctgatatccagtcagcct

SEQ ID NO: 10057 - DNA, 1153 bp, Homo sapiens
agtggcttccctagtgttcccagggggtcttgccaaaaccggattcattgtgggattcagagcaacccttgggctgctcatggagcgaccttggtatcaccctaagctgtcttccccaccctctgagtgttactgtcctcctctccaaagccagctgtaatttcagggtcccactggccctgggtccagctataacagtcacaggtgataacagctacatatcagtgtctctcgcgtattattttgctctcccaagagtcctgcgagggaaagattcttagccccattctgcagatgcagaaacggagacttaaggaggttaaatcagttgcttgaggtcacactcccaaaaggagcaaactcaggatcagacccagcttgacccgtgggtgctgcacctcatccgtcacctggccagggtccctagaaggaagggtctttcccctgttgttagctttcggggcccctgatgtcccctctcccccaacagcccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaaggtgatggccctgggaccccggcgtctggggtggggcagattgtcagggagcagagagtgggggatcaccctggctctgggcttcctggccaaccccccactcactgccctcctgcctacagatggggaaggctgagggtgtcatcaatgcagagatccccaactgctgggagtgccctcgctgcacccaggaaggccgcaccagcaaggtaggggctgggctgggctgagctgtgggtaggtgggtgttggggagctgtgcaggtcctcacccccagcttctgtcccgcctaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgagcc

SEQ ID NO: 10058 - DNA, 1402 bp, Homo sapiens
tccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccggggctgcggagttcgtgtgtgtatctgcggggtccctacctacagatgagtgggctcacctctcctggactcattttggga

SEQ ID NO: 10059 - DNA, 1100 bp, Homo sapiens
tttttttgagacggagtctcgctgtgttgcccaggctggagtgcagtggtgtgatctcggcttagtgcaacctctgcctgccaggttcaagtgattctcctgcctcaccctcctgagtagctgggattacaggtgcccaccatcacatccagctaaatttttttttttgtatttttagtagagacagggttttatcatgttggacaggctggtcttgaactcctgacttctggtgatccgtccacctcatcctcccaaagtgttgggattataagtgtgagctgccacacccggcctagtttgcacatttctgttcttaattcttgctgttattctgtggtgagaagaattcagggaaaaggggtcaggtctgatggatcccttattttgggccccttcccttgcccctcactttcccggatctctctcttgacttcatggagcttgctaaagtttcccgaaggacaaaggaacagtggtcagtgttgagaccccataccaactcctgttctttccccagctggacgagttctatattggacagattccactgaaggaagtgacttttgcaaggctgaatgacaacgtgcgggagaccttcctgaaggatatgtgccgtaagtacggtgaggtggaagaggtagagatcctccttcacccccgtacgcgcaagcacctgggcctggcccgtgtgctcttcaccagcactcggggcgccaaggaaacggtcaaaaacctccaccttacctccgtcatgggcaacatcatccatgcccagcttgacatcaaaggtgaggactcctctgcctgccactcaggcttggcctccagcggaggttgtacatgcaaatgcctgtcagggtcaggcaggcgcccagggtcatgatctgaaactgctggggccagttgtgtttctgaaatcagatcagattttagagtggaattatggtacatggatttttgtgtgtgtggtgtctccagcaaggtcgggcaataggccataatcaagcacataactatctgtaaaaaaaaaaaaaaatcatatgaagggttgtactaggtaagatgaatagattgtagtaaatcagcccaggtcaggt

SEQ ID NO: 10060 - DNA, 1165 bp, Homo sapiens
taaataccatgtttctttcctcacaaggtgtttctgaggtgttcactccacagctcctgcaggctccgttagtcccccggttgctgttctgcatgctttagtttacaggataaagagcatggggtgatcgagcctctgggtttgaattccaatttttccaatgaccaattctgtgactttgtgtaggtcgcttttaagcctctagaacagaggtactgatgcttcccttctggtgatccaacatggtaaaataagtagaagtgtttttgataaatcgtgaagtgtcataaaatatgttgtttgtggtagtttagaggtagagataaggtagaaggtcccaaaggtagagttatggtaggagaactgaaatcctgaaacccagattccaagaaattgtaggaaacttgaggcctgagaaagcaggaataccagatcaggaaggagttagtatctccatctgacaattggttcccatttccctccctccaggacaacaacgaatgaaatactatgaactaattgtcaatggctcctacacccctcagactgtgcccactgggggcaaggccctgagtgagaagttccaaggctcgggtgcagccactgagacggtgagaagtttgtggctaccacagcccctagccatgtgggcatggtgtccgggtgcccggagcaggagcagtcttcgggaggttccgggctttcccgttaaacaaagaagagccaagcaaagctgctgagatgctttcaaaagacagggaactaggggccaggcacagtggctcacgcctgtaatcccagcactttgggaggccgaggcgggtggatcatgaggtcaggtgattgaaaccatcctgactaacacggtgaaaccccatctctactaaaactgcaaaaaattagccaggcatggtggtgggcgcctgtagtcctagctacttgggaggctgaggcaggagaatggcatgaacccgggaggcggagcttgcagtgagccgagatcacgccactggactccagcctgggcaatagagcgagactccgtctcaaaaaaaaaaaaagggaactaggattcctggtttgggaaagggcaggtctcaagtggtgtttgagcccattcctctctccttgccctgctctgtcgctctaggccgaatcccgccgc

SEQ ID NO: 10061 - DNA, 1118 bp, Homo sapiens
ttcacccaatccttcgtccagactgggtcctgagacccactttaggaaggtttgagtgccagagcagcctgcttcccagtctccaagcctccacttcctcttgcttccgacatccctgtgcagtccccatgtctgtgtggtggactccttgtccttgagttcagcttgtcccctgggatgctttccttttcgggcctcttcagacagagtctggggcttcctttgccatcctccccgcatgctgatgtttatctcacagtgaaaatggtttgcttatgcagctccttggtctgttggacttccccgtccctagcccagagcccagcatccacagcagggagtgagtgaggagcccacggctggccaagtgaggtctgcccacctctcctgactgccccttctggatttccaggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggtaggtgccacagggctgtcggttagatcgctgtgtgtgtgagagagagagagaaaacagtggtgcttgcatttattgtgtacaagtgtgtgactttattagaaaaacatacaaagaaaatgtcaccatctcctgtcactaccttctagagacattgattgtctgacacacttcaaactgtaccgtcatggtggtttacagaaccccaggctaagctgcatactaaagtaaaatgggttggtctcttctcaagtaaattaaggagaaagtgcccagttgaataagttcttcctcctaatttttcttaagcctgttcttcagtgagtagtgaacaagtgcaggttattaaatgggcaaataggta

SEQ ID NO: 10062 - DNA, 1874 bp, Homo sapiens
gtggtgccgcccttctcagcgtggttacagcttgttgtgatggtgtctcctgttggactgtggctccgggaggacatggaaggtgtgtgtgtggactccgagtgtcccacacacgtgtcacagcgggaacgaatgggtgggaaaccccctctcatcaagggagttcatcttgctgggatgtggggctgaggccagggcgtctgtgttccctccggggttcctgggcggaagtgggggagagcacacagcctgtggtcatgggcggccagggtggctgagcctgggtctccctgacctcctttccttcctatgtgcttccttcccaggccccacggaggagtcaccccccagtgcgcctctgcgtcccccagaaccacctgctgggcccccggcccctgccccacgccccgatgagcgtccctcttctcccatccccctcctgcccccacccaagaaacgccggaaaactgtctccttctctgccatcgaggtggtgccagccccggagccccctccagccacaccgccgcaggccaagtttcccggcccagcctcccgcaaggctccccggggcgtggagcggaccatccgcaacctgcccctggaccacgcatctctggtcaagagttggcccgaggaggtgtcccgaggaggccggagccgggctggaggccgaggccgcctcaccgaggaagaggaggctgagccagggacagaggtggacctggcggtcctggccgacctggccctgacccctgcccggcgcgggctgcctgccctgcctgctgttgaagactcagaggccacagagacatcggacgaggccgagcgccctaggcccctgctcagccacatcctcctggagcacaactatgccctggccgtcaagcccacgccccctgcgccagccctgcggcccccggagccagtgcccgcacccgccgccctcttcagttccccagctgatgaggtcctggaggcccccgaggtggtggtggctgaggcggaggagcccaagccgcagcaactgcagcagcagcgggaggagggcgaagaggagggggaggaagagggggaggaagaggaggaggagtcctctgacagcagcagcagcagcgatggggagggcgccctccggaggcgcagcctccgctcccacgcccggcgccgccgccctccgcccccacccccgccgccaccgccccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaaatatcctgagtgtgggcggccttccccgggcttgggtcctcccccgacccctccaggcacctgcatctgtgccccactctgtctgcctcccctctggctccaagccatcttttctctcctcctggtgcctcttttctgccttccaaagcatttctggcaggaacgatggggctggggcttcctcccctgtccctcacctgggtatgctcagcggcgtgggccccgccctctcctttggctgggacgcaggtggccagagaggagccgttctcttccttaacaccctgcactcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggtgggcctaaccccgccgccgcgtcctcctgccac

SEQ ID NO: 10063 - DNA, 1220 bp, Homo sapiens
taccctgcatgggacccctcccaggacccctcctctgagcctagagctgggagcacctgtgtgtgcatagcagggagagggtgggagagctggagagccagccttggggacccaggtagggcctgctcatggactcagccttccttgtccccaggcgaaagacagtgatgatgaagaggaggtggtccacgtggatcgggaccacttcatggatgagttctttgaacaggtaatgggcctccaaggcccccagccccagccccagccccagcacccagccccagcccctagtcccaccgcccagcctcagccccggcacccagccccagccccagcacccagccccagcccctagtcccaccgcccagccgcagccccggcacccagcccctagccaccgacaacttccttttccctgtcccccacttccctgctcctgcaccctccctggccttttatcagccgttctggggctggtccattcccctgaaccctggctggttcccctggaacccgttgtttggcctgacagcttggctgggtatagccgattttctgctccaggtggaagagatccggggctgcattgagaaactgtcggaggatgtggagcaggtgaaaaaacagcatagcgccatcctggccgcacccaacccagatgagagtgagtgtggctgccggtgactgtggggtgggaggagaaggggcctggggttcccacccagacatctcacttgccctcgccctcccctcagagaccaaacaggagctggaggatctcactgcagacatcaagaagacggccaacaaggttcggtccaaattgaaaggtgaggagtacaatccctcaaccaggaaggaaaagaattgtgggtggagcatggtggctcaggcctttgggagggcgaggcggggccaattgctcaatcccaggagttcaacaccagcctgggcaacatggcaaaactctgtctctacaaaaaatacaaaaattagctgggccagtttgggaggccgaggcgggtgaatcacgaggtccggagttcaagaccagcctggccaagatggtgaaaccccatctctactaaaagcacaaaaattagctgggtgtggtggcgggcgcctgtaatcccagctactcaggaggctgaggcagagaattgcttgaacccgggaggtggaggttacagtgagctgagatcgcgccactgcactacagt

SEQ ID NO: 10064 - DNA, 1201 bp, Homo sapiens
ggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaccaggtcatcttctgtgttctggttgggagtgaa

SEQ ID NO: 10065 - DNA, 1099 bp, Homo sapiens
tccggctcccccgggagctgctggaacaccagcagtcccatgagggtgaaaggcaggagccacgctgggaggagaaagggatgcccaccaccaatgggcacacagatgagagcagccaggaccagctccccagtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcg

SEQ ID NO: 10066 - DNA, 1544 bp, Homo sapiens
acagcagtggttctttcaaaatgtggatcatgtccaagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaaggtacttgtggagaggagtgggagctttctgtcagtgttgtaggcttgtggatttcacacattagtaaaagcaagtctttaatggttgccagcagtaaaaacaagtcttagtggttgttgccagcttaatttgttgaggaaagagccttagttactgttttctaaaagagaagttctatcttaacacaaaaagtataacttatcagagtaccctaaactcttgagatttgtactctatagtaacttttagttttatctttcaatattggagtgagagacagttttctttaatggaggtttacatgtgaggtaggaagaagtaactgggaagaggggagctgaagtttgggaattataaacctcatgttctagaggaagaagatggaaagggagtactgtagcctttaaaattgatgttacctcattttgctttcttcagacaaacaagaaaacgggacagcccatgattaatttgtacacagacagggaaactggcaagctgaagggagaggcaacggtctcttttgatgacccaccttcagctaaagcagctattgactggtttgatggtatgtatgagaaggctggcagaggtggggctggggatatagggcagcaagccttaggaaacaagccatagtttgagggttcttttgagtcttccaacacttactttagctgcggtttcaggtagtctcatttttgcttatgtgtcagcagattataaaccatttgagaaaggcacgcttctcttgtattttcggattaatgtgtcttgcatttaaagtctgttgatgattttttgtttctctaggtaaagaattctccggaaatcctatcaaggtctcatttgctactcgccgggcagactttaatcggggtggtggcaatggtcgtggaggccgagggcgaggaggtgaggagctacctgctagtggtgcagaggggtaatggggagagtgcagaag

SEQ ID NO: 10067 - DNA, 1159 bp, Homo sapiens
tgggaccaaagaatccttaatttttcagcggggaggctcggggaacataggggaatgggaatatgatagatcttgtttcttttgtcctagggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggtaagactttaaatcagaataaaaaagtagagcagttgaacagaggccataggataacagggttttgttgagaaagtggtttcattttgagggctaggtggaaagacctgaggttgtaaccagtagtggagagggaaggaaaattaactcagggggagtgaatctgtagacccacttgagataagatactcgctgggttaggtaggaggggcagataggatatctaggcttggagaggctggtaactcaaatataatggatacttaatttttttttttttttttgcaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaattttgttcctcttcccccttttcactttcctggaagatcgatgtcccgatcaggaaggtagagagttttcctgttcagattaccctgcccagcaggaactggaatacagtgttcggggagaaggccaaatgatatccttgagagcagagattaaacttttctgtcatggggaaagttggtgtataaatgagaaatgaagaacatgggatgtcatgagtgttggcctaaatttgcccagctatggggaatttttcctttaccacatttatttgcatactggtcttagtttatttgcagcagtttatccctttttaagaactctttgatcttttggcccttttaatggtgaggctcaaacaaactacatttaaatggggcagtattcagatttgaccatggtggagagcgcttagccactctgggtct

SEQ ID NO: 10068 - DNA, 1220 bp, Homo sapiens
ggcagcaccccatgatctctccccaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttc

SEQ ID NO: 10069 - DNA, 1157 bp, Homo sapiens
ggagttcagtggtgcaatcttggctcactgcaacctccacttcctggttcaagtgattctcctgcctcaggttcctgagtagctgggattacaggcatgtgccaccacgcccagctaattttttgtatttttagtagagatggggtttcatcatgttggccaggctagtctcgaacttaggtgatccacccatctcggcatcccaaagtgctgagattacaggtatgagctaccgcgcccggcctcgatgccttagttttatactttatattccatataggcatagtatctacactggttttgtggattttgtatcattctctttccacagagttagagaatacatagaaaatattattgtgtttaaaagtatcttattgaatatttcaggtcactcatataaatcagtcagttttcttagctctcttatttcatcttggtttgtcaagtgatgaactctgcccatggccacatggtcaatgtgctatttatttttatttcagggactgttgacattcagggatgtggccatagaattctctcgggaggagtgggaacacctggactcagatcagaagcttttatatggggatgtgatgttagagaactacggaaacctggtctctctgggtgaggataacttgcctttggaatatctaatatctaataactaagggttttatttctttcctttgtagaatgtcacttgggagcttatgctttatatgaatgaattcagattcctgtttccaggaaaaaaaaattgtgggtttgttgtagaaaagacttcctaatgtttgatcttgacatttgccttctttcttgaggtgatgtagaagcttcactctagtttagtagtgattctagaaaattgagtgacataaactatcattgcccacactttaaaatctaattccttctccttatttttgatttagtcatacttggaagtgaagctcaggattcctgtgtttaaaatgcttcctgaatattctaaagaagctgacaggaaacagtatttggggaagtaattttctaggatcctctataatgttccctctttactgagtatcctactgagctggcaattaaagaactcccagcaagagtcatgtgactttttctaataaaacaggtctcgctgtctctaagccgga

SEQ ID NO: 10070 - DNA, 1453 bp, Homo sapiens
cagaagctcctcaaaacagttttattaaattgcctttcattttttgtggtacgtgcttgatcatgaatttgtacatattcttttgtaggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaacacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagtactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccaccgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaac

SEQ ID NO: 10071 - DNA, 1149 bp, Homo sapiens
actctttgagtactttgactacgagtccagaaagagcatgagttgttatgtgcttagtaatgttctggattataacacagaaattgtctctcaagaccaggtaagagaatacctacgtgctattttagggaaacagtgttacaattttagactttggacctagatacctgagatgggaggggagggtaattcaatactaaataaaatttacaagtaactttttcattatataaattaaaaattggagatgtataaagaattataaaacatttataattccaccagatagagaataaccactgttaattaacatttggtgcatatctttccagacttttgtctgtatatgtgtgtatgacatacatgtgtatcgactttctcaccaaaaaaaggaatatcttgttgatactgtattgtaattttataactggaaacacttttgataatggctttgtatgccaatggtttcacctcagtgggtttcttgtgcctcgcatgttacaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttggtatgagtttacccttagtatatccctgtatcagctcctagtgaaatcacatgttcaagtgcttaaaatggtttaattcactttctggtcttagatggttttgaaggaattgcaactgaattaaagattcacttgaacctgggaggcggaggttgtagtgagccgagattgtgccactgcactccagcctgggcaacacagcgagactccatctcgaaaaaaaaaaagattcatggcatccatgggcttttactttatatataaacacataattgtttgtaaacttctggagcatgtgagtaacaattcagttgctctgatttcttttgaagactctctgagaattacaaaaaagtctgtcttcttttgcttgagtgccgataattattccatgttcattttttctgaactatgtattgcttataataaactttataagaaatacaattcttatatttaattttacttttccaaatttgcaagtataaa

SEQ ID NO: 10072 - DNA, 1247 bp, Homo sapiens
ttccctcacaaagcttacattccaattaaaaacaaaatattcaacagtaaaatgatgtagttagcagtacaccataagtgttacattttttagccttttgtttttgtttttggtttgtggggatggggtctcattatgttgcccaggccagttttaaactcctggcctaaagcgatcttcctgccttggcctcccaaagcactggattacggacatgagccaccatgcccatccttctagcctttttcaattaaggaagttgccataagagcaagtccagttggcccaggatgaggagttggggaaagtaatttgccctttaaatttatactgtcctctccatggtactttttaccctagagtctgttccctttgaaatttaacactaagccaatgaagttgaaagtgattttttataaagcattggtgtactatagagataagtaggaaatacacaaaggagaaggatagtagtaagttggtcctgtaaatactgtgtaaagacttttctgtttctttgcagtgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacaggtttatatatttttgttacctcttcttatgttcagagataaactgaaatctgatttttaaaatcagaatatttttgttatacaatagtacattgaaaaacatcttaaaatggctgttattgaagaagacttaaacggaaagatatatatgcagtgtttgtggattggaagacttaatattgtcaaaatagcatttaaaaagaattgatttatagatccaatgtaatctcagtcaaaatcccagcagacttttgtagaaattaagaagctgattctaaagtttatatgaagaaacaaagaacctggaacagctacaacgaatttgaaaaggaagaacaagttgaaagacccaagcaacctgaattaatgatttactctaaagctgcagtgagatcctgtgtggtattggtgaaaaggatagacacacaaatcaatggaggggaataaaacagggaatggcaaactttacctgtgagggaccagataataaatggtttttggctttgtaaga

SEQ ID NO: 10073 - DNA, 1832 bp, Homo sapiens
caggcagacctccctcttccattcctagaggcagtttagctgctggattcgttcctctcccatcttgcagagcagccaggctgacactgttgtctctcctgccaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccagg

SEQ ID NO: 10074 - DNA, 1702 bp, Homo sapiens
gtccagtccacattcctttttttaacttttttttttttgagatggagtcttgctctgtcacccaggctggagtgcagtggcacaatctcagcttactgcaacttccacctcccaggttcaagcgattctcctgcctcagccttctgactagctaggattacaggtacccaccaccatgcctggctaattttttgtatttttagtagagacaaggcttcaccatgttgtccaggctggtctcatctcctgacctcattatccgcccgcctcagccttccaaagtgctgggtgggattataagcatgaaccaccacacccagcccctttttaaactcttaaacagacactggattctatgtatcaaaaggaaagttgatgaaaatattacaaccaacctggtttttgtttgttttaataaaggaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttctttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgctt

SEQ ID NO: 10075 - DNA, 1067 bp, Homo sapiens
ggaattgagccacttgactttgctggctgggtgttaactggttgatgttgggttttatgttgatcttggaccctccccccttccctgttacgatcatgtctggggagcactccagggtgagcctgttctgtaggagccctctgggcattctgtacctttttcaccagaggcagagtctgaaagtgggcaatagttgcagaatatacctggcactgttttgagggcctcagttctgttgctcttatatatgccattgtttaccagttccagtacaccttcctcatggaagtttctcacatactacttgggaatagctagctttcctaatgcggtttagggcactagggacagtggcactttggatttgcagtgagtggtagaaataaggttttgaaattaagtcaaggaacataatgctgcagggtgtacctccataatttttaagaaaatgtatttcttttgtgctttatttataggtatttcagagagatgggaatgatttgcacatgacatataaaataggacttgttgaagctctatgtggatttcagttcacatttaagcaccttgatggacgtcagattgtggtgaaatacccccctggcaaagtaattgaaccaggtaaatcttgattttgtccgattctggttttcaagtatttttgaaaaaaattacaatttgtaatttttttatactgcataactctaaaaaaaattgaacacctcttttgggtaaaattattaatcatttcctcttaaataatagggtgtgttcgtgtagttcgaggtgaagggatgccgcagtatcgtaatccctttgaaaaaggtgatctttacataaagtttgatgtgcagtttcctgaaaacaactggatcaacccagacaagctttctgtaagtgttctttaaattaaacaacagttgacttccaagtttggagttcggtttttggttttttagacagggtctctgtcacccaggctggggtgtagtggtgtgatcgtggctcactgcagcctcgacctcctgggctgaagcgatcctctcacctcagcccccaaggagctg

SEQ ID NO: 10076 - DNA, 1097 bp, Homo sapiens
ctgtcacccagactggggtgcagtggcatgattataactaactgcagcctcgaactccagcagtcctccctcctcagcctccccagtagccaggattacaggtgtgcactaccacgccggctaactttttttatttgtagtagaggcaaggtctcactgtgttgctaggctggtctcagatcctgagctcaagtgatcctaccaccctgacctcgcaaaatgctgggattgcaggcttgagccactgtgcttggcctcagaatgctgctttgaataaaaatttaggtagtgattaaaagaagtccagaaagcatatttaaagaataagggtattaagagtacagtatagtactcttgctgaaagtttcaatgacttctctttccaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtgattttcctttttttagttttttgtattttgttttattcagaagtacttcttgcttgtgagaaataggttagatctgtttggagtccctggagcaacactgaacactggtgaagttaagggcatcatggtgagttcctaagacgggcttgtgtaagaaagactaacaaggcaggtgcagttagaagcactgtaagagtcagttttagtcctggcttggtttcttccccctgcccctcagttggagtttcactcttgttgcccaggctggagtgcaatggtgcgatctcggctcactacaacctctgcctcccgggttcaagtgattctcctgcctcagcctcccgagtagttgggactacaggcatgcttcttcactcctggctaatttttatttttagtagagacaggctttctccatgttggtcaggctggtctcaagctcccaacctcaggtgatctgcctgcctcagcctcccaaagtgctgggattaaaagcgggagccaccgcgcc

SEQ ID NO: 10077 - DNA, 1131 bp, Homo sapiens
gttataactctagaacattacttctcagaaaagtggatattaagttattacaaaacttttaactggtgtttagttataaccttttttgtttttatccattttcaaaggcatacagaaagttagccaaggaatatcatcctgataagaatccaaatgcaggagacaaagtaagttatttgcaccttttttattccgggggttttagctttaacttaaattgccctccttgaaaaagaggaatgttgcaggaaaaaaatccaactatgcccacacagccacattttcataatgtcaagagtattttagttttagaataagagtactaccattctgaggagcggtgggtggtaaatagaaccagaatcaagtcaaaggtaacttgtccctttttttttttttttagaattaaatggattctggattcctgtagcttctccccactcttctacttgaaaatgcaattatttttatttttaccttttctttatagtttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaagtgaatatcttgttttgttgttttaaaaaattaagtactttttgtcaagtgggataatgactcagtagatgaaaaatctcatagagtgttctgtccttcattagaaaaacttccatttgccttgtcttcttttggtgactaaattgaatttgattatctgaatgtttctatttcgctgtagctcttaaaaggacagtcgatattttttaatgagaggaaggtggttttatatggttctgaggctgcttgttattataggacttaaaatttcaactgtgaagatcattttctctctctctctttttttttttttgagaccgagtttcgctcttgtccaggatggagtgcagtggcacaatctcagctcactgcaacctctgcctcctgggttcaagcgattctcctgcctcagcctcc

SEQ ID NO: 10078 - DNA, 1200 bp, Homo sapiens
agtattaactgtcacgcagggtaccccacacagtgtcccagtgttgaacacaaaatgcaaatctggaagggataaatatcttcaattcagaaacagcattaagtatacctgtataatactgtcaccattatcttccatctgcaattcaccgcatcatcccccaaatgcccacagatctattgcaggaaacctactaatcccaacatctaaagcatgtaggaataagatgtgatattccttttgtgtgtggggagagtgtcaatctaaacgtttaacaaaaggcaaagaatgttcacatttcacatcacaaaagagatttcaaagactcctttaacccgacagcgcttatgtcagtgtctttgtcatgtttcatagaattgttagactttaaaagaacctcctgaaagtctgcctctgaacatttgtatggttctgccaatgtctgatgagaagaatgcttccctgtttgaggagtgtgttcactgatgagaggggacgggagaagcctggttgtgatttcaggaataattctcaaaggagattatactcttattgcaaaatggggtctgctatatattgttcatgtcactttattgcaagtgacatgaattatatgacattaaaaataatatgccttgaatcacactgattagacccagaaggatcattgagtttttggtggttttaaagatccaagaaagacctatctagcccaagtgtatgaatgagaagactgaagcccacagaagtgaactcagcaccagtgtctcaagaaccccagtactctggtttttttcttttttgagacggagtctcgctctgtcgcccaggctggagtgcagtggcgcgatctcggctcactgcaagctccgcctcccgggttcacgctattctcctgcctcagtctcccaagtagctgggactacaggcgcccgacaccatgcccggctaatttcttgtatttttagtagagacggggtttcaccgtgttagccaggatagtctcaatctcctgacctcgtgatccacccgcctcggcctcccaaagtgctgggattacaggcgtgagccaccgcgcctggccttctgtttttgtttttctgtttttttgttttttgagacagagtctcgctctgtcacccaggctagagtgcagtggcgtgatctcggctcactgcaagctccgcctcccgggttcat

SEQ ID NO: 10079 - DNA, 1551 bp, Homo sapiens
tgcacagccctgccgctcattcgctacgcggctctggacgaagggcttcacctctctggcctcgactttccaatcccctaaaacctacttcatgagggggagtctgaggagttggtactaaagtgcctgtcaacctggcgggcgctagggaaacgccggcagcgccgcgggtcgggaactcaccggcgcgaagggcacggagagcctcgggctccctctgccgatgtccgcgcttccctgcccagggtcgagcaaggctgagctgggcaaagttttgaccttgaatggaggtctgggggactagggaccggcgcccctctctgtctgctagggctggcggagacccggcaggccggcgagggtgcggggccgaggtgggcggcgcttcccgggcgcctccgtcagacgggaggcatcgagggctcggccagctgccccgggcgccctgcgcggcggctgggcacgggccggtcactgccccggcgccggcctctcggacgaggccgccgcgcagccacggcgagaggcaccctcactacccccgcgcccagccggctcccagccctaacggcagccggcggggagcgacgccgtcccacggcgcgaggccgcggcgggcgcgcgaggcgcggcgcggggcggggcggggcgggcacatgcgcacaggcggcgcagccggcacgcggcgctcgcgctccctccttaaatgagcctgggcgccccgcgcccgccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaaggtaaggaccggggctggggccacggacggcgccccctgcgggccgaggctggcgcgccgccctgcccgcgcctctgcgtcccttacccgcgcccgggacccgacgcgcctctttgtctggcggggctcgcggctactcggagcggaccgcggggcgcgagccctgcccggctccgccggctctccgggcgcgccgcttccgacccctgcgagtccggccgacgttcgcggggcgcgtgtgggaagagggatcgggtcgggaaggcggccaggaggcccctgggcccagcagggccctccgggctgcgccctcgcgccgcttccgtagaattccgcgcatccctttgcaaagttgtgagattcctgtcgtggagcggaggccgctctttctccagatgtgatggcaaaaagtaattccacgagaacaataaaagccgcggccgtgacgtcgtg

SEQ ID NO: 10080 - DNA, 1247 bp, Homo sapiens
tcctattttcaagtagataataaatgataagaagctaagtatttaaggaccctaagtatttaatgtgccttaagtattcaagtatttattgttttttaatcaattagatcattaattataaaatagctactataaactacaaaaatactaggactgttgaattaggaaatcatatctattatctgctaattgctggagacttttaaaaatgaatcactgtgtatttcagaaatgagtcttttcataacatctttctaccatttataaacgagtctaaaattctttttcagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaaga

SEQ ID NO: 10081 - DNA, 1162 bp, Homo sapiens
atttcagcatgaaacctagctgaatattcgtggagtggatggctttggagtatgtgaacattatcttctttccttgagggtttgggggtatgattatttgagaaaaatttgtgtaatgaaacattagcataaggaatgaagtttggatttatggtcccataattagacatatttcttaataactagaatctattgacaaatgactaccacatgagtattagtgacacttagttgtttggaccatgtacacatcagttagttggattgagtgctggaggtaagggtgggaatatcccatgacatttcaagttcttctgtatttattttcaaaggtactttattccccctcttgttcccccagcaagaaggtttacaagtagtaaagtatggtacttcacataaaataatggaagttagattaagcactgcttcttcatttgtttagagtttttctttgtttatctttgtgaaaatgactgaatttgatgggtttttattttttcttttaggctcagtttatgaacctcttaaaagcattaatcttccaagacctgataatgaaactctctgggataagttggaccattattacagaattggtgagtaaaacctgaggaaaacgtgtccttaggtatctgcgattagtattccccttgccctagttaaattatgtacattatgtggatgatattgttctgtcattgggatttggggtactttcagtgcttaagtagctgtgtattccaattgtatgtcgatatcaggactataaaaggaatctggcagatcatatctggcccttgaagaatttgaaaactgtcaccaatatcttctgtgtttttttaatcttcctaaacattaccagatttgagaccttgaggatgtttcttgattaatacacagatatttcatataagtattaatttgctcatttacctaaacatggttcccagatagtcctaaactttttatatccgtttctaattcattgagatacaagagataatcacaagttagtattattaatatcagggcgcttgtgttttgtttgttttattttgtttttccaggaccagccttgcaaattttgtttttcaatgtgagtaagcaactttcagatatgtgtataagggcctcctctttgtttgtcagaccatctatt

SEQ ID NO: 10082 - DNA, 1170 bp, Homo sapiens
tgttaaatgagacaatccatgtgacacataaagcatagtgcctgatgtggtgaatatttgttcagattagttgctttattgttatttgagattctcctgtcttcatattttaatccagtattcttttacattcatctagattgtatctaaatttgtttagtttgatcatatagtcaatatttatgaggaatgtacaactcggattttatgaatctgcattctcattctttgtcatgttagctaaactaattgtattttcattaaaataaatgtcactaatatattggctatcttgtaatcagtacattttgatttataagaaagtcaaggaaaactagggaaaacaaaaataacatttttatgattataaaattaatgtttattgcaggatatttgagaaatattgaaagtacaaacaaaatttaaatcttctggaactccacactcaagatgcagacaatgtcagtatttttgtgaagttttcacagtcaaaatgccaaagttctacaagtcttttttcttaatttaggaaatgtttttctttttctctgtccagggctgttcgtggtcagttatatttgtggatctcgatgctcacaatcgcaacaggcaaactttgtgctcgctgttacccagagaatcaagatcacatgtgagacatttaataatgataaatttaacatgaactattgtttatgatttctatgtagttatatcttaatttccagtaaagtactctaaaatgttagtgatcgtccagaagggataagaggacatgatagatattgccccttactcctctggcctggggaggtcttagcaagtggacaagagttgtggacacggctgctttggcctttgaatcttttgcaggagaatagaaaaacagacttttcttttgggggagtagcaacattaggccaaggtgaattatttttttgccatggtatattagaaaaatatttttcatagtgtatatatcttttggataaaataaccttccattccttatttctgttctctcattcaattcactttttccccttgcctgatcaacttctgtatgcttatcctacctgattgcagaattttctagggactatttgtggttctgttatttagaaaacacccaaagtggaataatttagttattcaaaacaactcttttat

SEQ ID NO: 10083 - DNA, 1919 bp, Homo sapiens
gcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttccttttt

SEQ ID NO: 10084 - DNA, 1835 bp, Homo sapiens
cggaagaatcctcttcattcattgctagtgcttcccctcacctcccactctccacttcccagtttgcaaatgtggctttcgcccaccaagtgaaagcggactgagagcagcccttggggacggcccggtgcctggctgcaaggccgcgctggggctctgtcttggtgcacatggcttgaccggactttccctgcttcccaccacttccctcactcccagacctccctcattctttttgtctcttctttttgcctaaagccagtccttaacaccctattcttcctctgcaggtggcttgcagacttttccccacctttggggctcgtggtggtggagagggcagctggtgttaagaatgtaggttaccgggcatgacccggcagatgcttgcccagtagttctggaggaaggcccgggaatctgcaaatgagcgcattccccaggcagttcccatgcaggtgatccacggaccacatgttgagaaactgcagtcacccttagggccacaccgtccctctcctcgctgtcccctctctgtagtgactggccctgaccttcaggagtgcactttccactctaccaggaagccctatgacatcctcaggctccccagacctgcagcttgcatggggcccctcccttcttccacacccaccctccgtatggtcccctgctctgccctcgtgctttgctggcccctgcccgctactcccactctcagacacccaggggtggtgggccctaactggctggcccctcccagcgctgccctctgccgtccagatgctgcagtgtggccagatttaccttccagtaacatacttctagtcacccctcctcctgcgaagtgatctgcagtggctgtttgaccagaccacaaagttcacatctcctgagcttagtgtccgtggctgtccacctcccagccatacttgactgtccccaaactctccctgcagccacatgtttcccatgacctgtgggctctgcagatggacctctctccgctagagatgcccttctcccaaatggcttccctcctggaaggcccagcctgagtcctcgtctcctttccagtgcttctgccagaagcatccccatgatgttgtgaccgcacagcactttgtgtctcgctttgagcacttgccactctggctggtgctgctgccactgattgtgtactgtcttgctgccctttctagactgtgagctcctcgtgggcagggaccgcctgtgttctctgtatttcccacggcgcctagcacagtgccttgcacttgataggtgcttaataaatgtctgctcaactgaactggaggacagtgccttcttgactgcggcatctggcagcaggaccagtaagaggccgggaatccactgccctgcagtgggacagtggggtggggctggggtcactccactcccttctccctcccctgccaggctccagcacatggcatcctgggcacacaggtccggggaggggtacctggcgcaggctgcatactagatgcactcaggcttcctggccagggccgacagccggcccaacctatgccagtccaagtcactcctggggagttcctctgtggtggtgggaatcgtgggatgccaggcccaggtctgtcagaagccattttccaccctgggggaagtcgacctgtggcaggaaagaagcggcgacgtgagagaggttcctggcagcatgagccttgggttcctgttgtcaggaaagcccttcctcggacgtcaccacaccccagtattctaacacactttttgcttaagctggtcattccagttggatttacgtcctttgaaatcgagtcttgagt

SEQ ID NO: 10085 - DNA, 1860 bp, Homo sapiens
cttggtgcctagccatggtgaatgaccagggcgaagttagtctcacagaataccagggctagaagacatcgtggagcccatggagtcccaccctccttcccccttccaccctgcgcaaaaggggacggcccagtgtgcacgccgtccggccatgcccacagccacagccacagctgaggagtggccgggcaggcagcaggctccccagccagggcttgacacgcccacagtcaggggcctccacatgcctggcctggctctggaagtcacgtcttagcttctgaacaccgtagcgggttatgaggaagtttaatgaagagcccggtcactgtggccatcttgtgtccccaactgcaggagacgccctgatgtggagtttgtacagctttgccaaaaaatggttttctattctcaaaagtgacccaagccaataaatagcattagtagcttctgtggggggatcccagagcccctgtatttattttccctgtgtttgtctctagtgtcctcctaaacagcctttcctgtgagtctttctcagaattgatatcttaatattgtctgttctaggtgttgcccaaattcagtgtcagtgaagttcttttcctgggcaatcttaacatctttactcttattgtctggaccttcaaagggctttgtattttacacctgcgcccccaggctgctcacagtcggcttgctgcctgtcctgcctgtccggatcttgtctcctagtcctgaggagcggaggctgagaactcagtgctggtttgtaaatggtgaggggacttgggggcatcccagagtgctccctccaggcctgcttcttggttttgtttgatcactgcgttcttcaagggatgaatccagagccctccatgaggccaagcttgtccttcaatcatgtttcctctcagatgcgtccgtgatgcctcctaatgtggaactggttgtccattgtttgggcctatggccaagtcacccagctgtggaagcagaggtagaagacgaggccagccaggagggcgacttcagtcacagctcccatgcctcagctttgtacctgttttcaaaagcacaactgaggtgtgcgggctggagctgtcttgcagtgattctggccttctggctcatggttcagtccagcagcctggctgacccactatttctcctctgcttcagaggaaacccaggaaatgcccttactgccaggctgagtctccacccatgctggttggtgctggctaggctgagggggccaccacttttcctggctagaagctacttgacctttgatgtttgagttctgtaagtcttcgtgttctgacttactgcttcagagggattggcctgtcccctttccctttctcggctatgggaaggaaggattgctcattggttgccttcatcagttacagcatgagacggaattcatcattccttccgaaacccctgatatttaatatttaatatttaaaaacccaaattatcaaaccattaagaactcattactggttctcagcctcctccagtactagcctcagtgtggctgctgcataagtatctgtagcctgtctacctcctgcagtggggccgctcgcctcttccctgtctactgctcaggctctcccacttcgtggcatccatgtaaagtaggtggcagggcagagatgtcactctcattcaacagggaggatgtctgttgctcagagaggttgtcctgaggggctgggtgattcctgggcctacattcttcccgaggctccaggccgctgtctctggaagtaaaagagccttgtctgaccttaatgcaagcagtctgtttgaacccctgtaggctgcattcaggagacagaaggt

SEQ ID NO: 10086 - DNA, 2459 bp, Homo sapiens
ccaagggtaatagtagcaaaagtcaagatttgttctgtagtcaatcacttgatttgattatcttatctcttgattatgtcatggaagtaataaattactggtagcaagcaaagatgtcttttcattagagatgtaaataaatccagccttgggattattcactgtgtagctcagcaaatccctaagatcacattgcataaaatgttacaaaatacccaccttttagatttggatgcagagttttcagttcctctaaagatggtttaagcaagttatatctgttattttcaatgttttatttaaaacatgacattttgttcaaaattacaaacatgcttgtgatttttataaaatcggcctgacatttgtagttacatggtaatttattatgtgctataaggaacttttgtaaattgacctaatttcttattttctctttacaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacgtaagtccattctctgcagattattttattttaaatagggctctaaatggtgtctcagaatcacatgtatatgggaactatacatacatgttgtatatagttgatctgtagccttagggtcggatggtggaggggaatgggaaccaactggttggaaaggttttgtcagtccatcttctggattcatgaactttacttcaccctgctgaacttaatttctaagggcaagagaggatagaaaattatcttttcacgttgcattgctcagtgatatgtagtatagtgacttttaagtcattaaattcttaatattgtgagtaccatt

SEQ ID NO: 10087 - DNA, 1792 bp, Homo sapiens
gctgtgggacaactttgtccatttccttattaggagaaataaatttcgcttagctctgcgcactcccatttccaaaaataaactcgcctcccccattccagttgcagtaatcaagaaagagactgccttgtcattgtttcttatcccccaacttcatgttccctgcaatttatttaaagaaactttgtatttcactacataatctgaaatctttctccctagccccctctgaatccttctgcctactgaaatctgatatattacacacccccaaccttttttttttcagtttggaaaggggtaaagttttgttgttgttgttgttttgttttggatggggaaggtagttttaatttggcaagtgttgctcttcttaaaacactgctcaaattaattagctgaagatacttagtatcctcggctgcttgttagcagagaaaggactcaccttagtggtgactggtttaaaaaatataaatatatatcatttgtatacgaagaactcttcccagtggaaactggctgtgtttccgtatttctatgttctattcggagtgatcgtgaaatctaaggctgcttgatgttctgatgcttgtcaatgccgtcgtgctctgtgactccacgaaacgccaaggagcttcttccggacgcctcctcttcctctgtaacatacgtgtgaatagtcaaggtttaattttgctttaatctaataaagtcgaagtgggacttttatttttctgaaacagctttctaaaatccgcatcttccccagctgcgaggttgggggtctggggtgccaaagggcgaggttccgaaaggcaggagacttgggggaacgcaaccatagaaaggcctgggcgcgagggcttccttgcaaagccggccttgcgctccttcctgcgccaggccggggaccagcactgcattcgcctgtgttcacagctttggcggaaacgtaagaaatgtggccgaaatcttgctaggccaggcgcggccgccggcccaggagcgaagtttgatttttttctttgcattccaaatgcatcaggaatagtcccagtttgaggacccaaacgaccctgcctggagcggcagactcctcaggccttctgtccccggatgtctcccaccgcgtccccctcgcagttcccgaagcagcgtatgttttatacaccgcctctgaatccggagtccacccgccgcatactcgggcgcccaggacctatgattccgctcattcacaggactttattcaagaggttcgtccaggagttttgattgtatcggaacataatgtgaaagcaaaaatgaaataaacgacttcgttttaagtctgaaaggctgacccagttgcttcggcagcggggaggtcgggagccggagcgagtgggcagcctagggcgaagggccgggagctgggagctgcagccgggtggtcccctgcagttgtggttcctttcagagaaacgttttcctggcccaatattcaggaatgaattttatttcctctaggggcgtggggagaagggaaagttaataatagcacaataaacaacgtttctcggatttatcccagcggctggttcgagttagaaattcacggagcacggggcctctgttgaaacccgggcccgtttcttctccgcatgcaatccggtaagccgtggagcagctctagcgggcgcccttgcagccctgtgcctccgggacccacagagatagatagggacttcgcgagtgaggagtggacccgagtacttttctgtttctgcccaacagtttcccttctact

SEQ ID NO: 10088 - DNA, 1198 bp, Homo sapiens
gcactgagtggggcgggcaatgagggttgataaggagaggagttggccgtggtcctgactttaagaagcgcgtggctcaataaaagttttgcccattcgtcaggaattgagatgtctggggaaatgtatacggagggcaaaccagggggtggtgagaagccagcttggctcatccttggctggggatgtgtgtgtgtgatatgtgagtggagtgggtgataggtgtttgtgtaatgcatgtatattagtttgtgcgcacatgtatgagtgtgtttgcatgtgtgaatgtgtgtgtgagaatgtgcatgtgtctgtgtgcgagtgtgattgtgtgttcacatatgccagaatgtgcatgtgtgtgtgagtgtaaatgtgtgtgggcatgtgtatgagtgtgagtgtgcgcgtgcacgtgtgtgtgtctgtgtgtgtgtaaacgtgcatgtgtgcattgtgtgtgtgtgtgcgcctgtgtgcatgtatgagtatgcgcatttgtgctcttgcatgtgtgcttgtgtgtatgagtgtgtgcgttgggaggggggtggggtgctggctgtggaagggccacccttgccttgggctaccctagaggagacaccggctccgaggcacggaccttgcctgctatcttgagaccgaccagcagatggcggaattgcaacgggaaagtccgggacctctggtgctggggagtcggaggagggaaggaatgagagggaggagggagagcatctgaatctgttggagctgccgtgacaaaataccatagacttgggggcttaagcaacagaaatttatttatcacaattctggaggctaggagtcaagatcaaggtgccggtgaagcaaggcttccgtctgagtccccttctctggcgtgtgggcggctgctgcctcgctgtggtcgtccctccatggggagggaccccttttcctcttctcataaggaccccagtcccatcggttcagggccccatctttacaacctcatttaacctcagttacctcctaaagaccctgtctccaaacacagtcacattgggggttaggaatgcatttgcagggaattcaaacattcagtcaatagcatggagagaggagaaagagacagggagagagagggagaggggaaggagagggaagagaagatggggcagaccccgtggcactggtgcaggtccggacggct

SEQ ID NO: 10089 - DNA, 2350 bp, Homo sapiens
acgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccgggtaagtgcagtccacctcatcctgctccctgctcctctccttggggctcctctggt

SEQ ID NO: 10090 - DNA, 1179 bp, Homo sapiens
aaattttgcctgtgttcataaggaccagtgggatttccttccctccaggattagggatttgaggggagttgactcccaggtgtggatcaagtgacaggacttgtcttccttttggcctatgggactggtggtctgtgagttcgtttccagtgactttgtccaggctgcccctcctttccctatcaggaaagtggccgagagcctcccctctgatggggggtatcatgtcctgccaggtccaggcaagtgttgtgaagggaaaaggcgctcccccttcattatctgccgcccctctggcgtgccctctgcagacaggaaggccctggtgtccacttgcttccggcccctgcccctccccacagccccctgcagccgttggccagctgcacagcctcagcccgcgtgctgtcgagaagctggctctgtccttgtttctcggcagccctgggaattgcctctaatatcctctctgccttctcttgcagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaa

SEQ ID NO: 10091 - DNA, 1121 bp, Homo sapiens
ttcaagccgtacagcccttccatcagcaaaagagaaacatccacccttctttcccgtcctcttcttggagtctctcttctggtttccctgtcccccaatcagaacaccctctgaacccccagttctgtggagcaggccaggctgtcccggattgggagaccagccagggtgaggcgaacaagaccaacttctctcagggaaaaggaggagtaggaacgggccgggcgctccgtttggactcagttggtctccttctaatatgacggggaggatctctgctgggccgggggcagtccctccggggacttcaggaggacagaactgacgagtgtctcaagatcctccttgccagattcagttccagccattccagccaggcgcaaggctggcaggaagggagcggggccccagcgccttcccgcgcaggcctccaggaaatgaacttttcagagcagaactgggctcaggccagaggtcatcaggggagatgggagaagacaagggcctgggggcttttggctccgtagacttagccgctctcatcgttccccccttcctcgatcatctcccatctcacagccgagcgcccgggcacccaaccgaggggctagaatcgggacaaagcagcaggcaaggcctggaaaggccagccgcggggagaggaggccaggggaggggctctgctgccggcgcgcggcctttccccggggcctctactctccaggggtcccctcgagctgggggccctcgctggaaatagaaagcaaagcgtggagacgaagggatgggtgtgtgtatctatatatctgcagctccccacaaacgcgcgcaccccggggagccagcacagaaagccggcctgggtgtcgagggtgccggtgcccggggtcagatccagggtgccggtgcccggggtcagatccggggcgccctccgcggaggggcgcgcaccgcggccgctgagctcccctgaggacctgcgtcccgccggcgccgtgcagacaatgaactcctggcggaggctccctgcccggtgggcctcggtggaggaggcaggaagtgcaggggcccgggccgggagaaggcctgggcaggggcgggagggggcgccaggcggccgg

SEQ ID NO: 10092 - DNA, 1172 bp, Homo sapiens
cctgggcatggaacccccggcatccacaagaccaccttcagttccatcgtaaagtgtgacgtggacatccacaaatacctgtaggccaagatgatgctgtcctgcggcaccaccgtgtacctggacatcacgggcaggatgcaggagatcaccactctggcgcccagcaccatgaagatcacaatcatcgagtcccctgagcacaagtacatggtgtggattggcggctccatcctggcctccctgtctaccttccagcagatgtggattagcaagcaggagtacgaggagtcagccccctccatcatccaccgcaaatgcttctaaatggactgcgagcagatgcctagcatttgtggcgtggattaattcagaagaataaatttgcccctggcaaatgcatacaccccatgctagcctcatgaaactggaataagccttcaaaaagaaattcgtccttgaagcttgtatctgatatcagcactggattgtagaacttgttgctgattttgacctcatatgcaagttaactgttcccttggtatttgttaagtattctgtacatatcttggatctcaacccttagtacatgtggcttggtcactttgtggctgaggtaagaacgtgcttgtggaagacaagtccatggcttggtgggtctgcgtggccagcagtctcccacgagtgcagggtgttaatgtgttagggctgagtgttctgggatttctctagaggctggcaagggctcctgaaccagttgtttctgttctgctggtctgtcagggttggaaagtccaagccataggacccagtttcctttcttagctgatgttttcctgccggaataccatggctgttacttgccttgagttggaagtggtttgcatttacacctgtaaatgtattcatccctttaatttacgtaaggtttgtgtgtgtgtgtgtgtgtgtgtgtgtgtgtgtgtatgcaattctcaattctttaagagatgacaacaaattttggtttcttacagttatgtgagaacattaggccccaacaacacgagtgcgtaaggaaaaataaaagtgctgatgaaaaagaaaaaaagaaaaattatccaaaacttggaaataagcaaaaaggatagctgcacattttttctgtttcttttctttatatatgtttttta

SEQ ID NO: 10093 - DNA, 1176 bp, Homo sapiens
ctcatgtttatatgtcagaccaaccttggaattttagtgcattccatttcactcttggaatataagaagctgctgaggagagcagcttaggttacaatgaaagaaagtgatgccactcactttgtcattttaaaagaaacttgatcagtgttctctgggtctgctgataatgcagtgtatcagagaaaggcattgtgtgccaaggaagggagatgattgtgcagggttataactaagggcactgcctcagtgcagaactcattgatatttaataaataatgaacaaaggcagtagggctgagattttttgaaattacactggccttaaaagctccagtcttgtgaaaacttaaacttagtaaaatatttcacaggcatttcttatccttatgcttgtttttttcccaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccggtaagtcaggttgctgttctcaaatatggattaatacagctgttttttttttccagcagttatccttggctttgcagaaaaatgttatagcaaaattagctataaagtgcgttttggtaaaaatgagtcatattttcctgttgattctctttatgtcattaaaaatctcctaaagggggaaaaaaatctcttgtctaaagtgaatcgttttatatgcaggagaaggtttcagagatgggatagacctatccttttggaacactttagaaatagatgatcaccttcgtaactcttgcttctccccacttctgttacatactgtctgccagactgtcttcaaactaaaggaatttgtactttgcctgaattgtcccttgcattcttgcctcttattttagtatgtagccttatcaaggtggcaaaccaaaccttcatttatccagtactgatccaaagaggttgggtgactgtgagatgaatgatggtttgt

SEQ ID NO: 10094 - DNA, 1194 bp, Homo sapiens
ttcacatagttcacatttggaaaaggcacaaaaatcaatacagggaaaagtctcagtcccacctctgccccctggttctccttggaacagccgcttttaccagtttctcacatatcctttcagagatatctgtgcatataaaaggacatgtgtgtatattaacacaaatggtagcatgctggatacctgttctgcatccagcttaaagcacttcataatatttctgagttgcaattaatctcatccggataggaaaatcattatgtctagtaccacaagcgtttattaaagaaaatacatgaagtgctttttgtttttttttctttgaggttttacttctttcaaaatcaccctatttcctgaggcctgaattctgtgaaatgactgagaggaggagtttgttaaaatcaacaactactatttcccttctccacaaaaccattatcaccaacacatttagtcttcgttggccagggtgggaaataggttttaattgtactaatgaagtctataagcatgagtgtcagttaaaacaagtttccaacttcttccgaccctcttgtatatgtattctgtgttcagtgacatcgacctagtggtgtttgggaagtgggagaacctacccctctggactctggaagaagctcttcggaaacacaaagtcgcagatgaggattcggtgaaagttttagacaaagcaactgtaagttctgcagcatttcatattaaaatccttagttatttacctatgaaacttgaattaaaattaaagtttggtgagcacagttgcattgcaagtgagtgattctttcattttgttaatgtcaccgtgcttgcacataaaaagttttctggttgtccacactggagtgtgaccatacaatctcggctcactacaacctgtgcctcctcggctcaagtgatccttctacctcagcctcttggggagctgtactacaaacacaacctgccatgcctggctaattttgttgtattttttgtagagacggggtttcaccgtgttacccagactgatctccaactcctgggctcaagtgatccacccacctctgcctcccaaaatgctgggattacaggcgtgagccactgcacctggtctgcatttcttttcacagcagcaaaatatgcaattttattatacacagtactcactgtagagatttttgtttgttt

SEQ ID NO: 10095 - DNA, 1119 bp, Homo sapiens
taaatagtataaatgccaacaataagaatgtcttctaagcagctaaatcttgtaagtttagttggaattgagaccagctatttgggtaagcgaattagagtcttagtattgtaagtgggtatgtttatgtggcacagggttgccaactgcctgagtctattcgtgagtcagaacgactttgctgatgtgttgggccaagccagccctggttggcagcctggtgcagccgtaaaattcagccttacaaacagtctcccgccattcccgcaccatgggactttagtgttgtgtgtaacaacagtataacctgctgttagcccattatcaactgactgctatgctaaaccaaaattataataatattgcttgtagaagttagaatataatttattccccctctccttgataatttagcaaaaatccaatataatttcttcttttctgcttttagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtattgaaattaggtaaatttgtgggcattcaaagagagggcactgtcagtcaccttattatactttaaattctctttagatgaaaaatgaaggaacaacttctaattgttattcttttttcatcgaaatatttcatgagcaaacatactaaaataaacagacacagacaatagaaaaacaccttggagacttccagataagtagggagtagaatctgtttaaccctaaaagcatagtagaaaaggcattcacttatttggatgggttcatgtttggtggctgtttctccttcttgggtccttattgccttgattacaaccaattgtcagcaattaatgaggctttaatgagatgattctgaagtcctgagaggcagcaagcatagtaatatatctttgaattcatgagcagaagggtgcaaggagacaatgtattttctttttgaatttctcc

SEQ ID NO: 10096 - DNA, 1165 bp, Homo sapiens
gtgcatattaagcacagtcaggcttactatgttacgtatatttcttttaaaggtaacgatgttggaaggagttcatatggggccatgcaagtgaagcaggcctttgattatgcctacgttgttttgagtcatgctgtatcaccaatagcaaagtactatcccaacaatgaaacagaaaggtaaaagttcatctataaccagcccattgtgtcaaaattagttgtggcttcttatcttcaaattaatgttattccctccctctccctttctttttaaacacatgcagcatactaggtagaataattagagtaacagatgaagttgccacatatagagattggatatcaaagcagtggggcttgaagaatagacctgagccttcatgcaatggtaagatattttccttggtcgattgactgagtattagaggcttttctgtgttgtgtgcgtttaatgggaagaaacgttttccaatcttttgccactctttcaggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagtaagtatgaaagcctcggctcttctgaactcagatgcatgcacgttctcttgctggggttaacactgtctcgaaggctaaggctacttcctttgcttacatgttactgggatattttaataactttcatgcttgtacattttctcaacattttgttatgaaaaagttcaagcatatagtaaaagtgaacaaattttagtgagcattcatgtactcaccagtagattctgctattaaccttttacttgcttatgtcatacctgtctatccatcactctatccattaattcatcttattctttgatccatttcaaagtagattacagacatcagttcccctagagtactgtagcttgtgcatccttgtagccagactccagtatttgtttattgttttttccttttttttttttttgagacgggatctccctctgtcacccaggctggagtgcagtggtatgatctcggctcactgcaacctccg

SEQ ID NO: 10097 - DNA, 3120 bp, Homo sapiens
agcaggaagggagtagccacctgtgctgacccaaacctaccagtgtgcctgtcatgcccaagagcctcttcccgctctgtcacttatgatgtggtgtttgggttggtaagtttcttaagaaaacctttgcatcccacacactgttaagaaggcgggcgagtggtctatgcttttcattatttccattaaaataaagtaagggttttagagctaaaaagaacccctgtaacagctttttctgcccactagataagtcagtgatcagtaaggtaacaatctagccagcatattcctagttttgaaagcttccccaaatccaggtgtttgagaacactctgcttttctgcaatactgatgtctttgtggtcgttttctgtttctgcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctcatttgttttatacatttcatctatttgactcctatcttatttc

SEQ ID NO: 10098 - DNA, 1272 bp, Homo sapiens
ttttctctgggaaagcagaaagctatggtgactatagtcatccctcagtgtctgcccgagattggtatcaggacctcggatttggtatttaccccacaaagatagcaaaatctgtagatgctcaagtccctaacataaaaggtatttgcctataccctacacacaacctccagtatacttcaaatcatctctacttatatacttcatagaatgtagttaatagactgtattttttatatttttttcattgtttgttgtatttttttaattgggttttttccccaaatatttttaattggcagttggttgaatctgcagatgtggaacccatggataagaagggtcaactgtaaaaggaacatttatctgtttttaatgtataaactactcttagttttctttttatcttgtctaaagaattaataaagatttcctgtgtgcagaagagccacaatgatcacctgataatgcgcgtagtcttcagccttggatgtggtgaagaagggctctcagcagttatgcttctggatggcagcttgactttcatgtcccctttttaattaaaaggtaaaaacaatgttgaattaagtgatgtctttttctttcagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaa

SEQ ID NO: 10099 - DNA, 1676 bp, Homo sapiens
agcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtgtctgtgtttttagagtgcatttccatttagccaggccccaaatgcgttttaacatttccccaggcagcagtcaattgtgtatgtgagtgtgtatccctctttaaatgaggaattgtaaaaggcataacaaacggctttgcatgggcctgcgttttcttttattttgaaatttggaggccctagatattttcccagtatctatgatttatttaggaatggattttatagactccactcgctacccaccccacccccaagaaaagcaaaacaacgaaatgac

SEQ ID NO: 10100 - DNA, 1638 bp, Homo sapiens
gcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagac

SEQ ID NO: 10101 - DNA, 1840 bp, Homo sapiens
catcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacacgaagcgctccaggggctttgggtttgtcacatatgccactgtggaggaggtggatgcagctatgaatgcaaggccacacaaggtggatggaagagttgtggaaccaaagagagctgtctccagagaagattctcaaagaccagatgcccacttaactgtgaaaaagatatttgttggtggcattaaagaagacactgaagaacatcacctaagagattattttgaacagtatggaaaaattgaagtgattgaaatcatgactgacagaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttggcaattacaacaatcagtcttcaaattttggacccatgaagggaggaaattttgaaggcagaagctctggcccccatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtataggcaaaaaactcgaggactgtatttgtgactaattgtataacaggttattttagtttctgttctgtggaaagtgtaaagcattccaacaaagggttttaatgtagattttttttttttgcaccccatgctgttgattgctaaatgtaatagtctgatcgtgacgctggataaatgtcttttttttttaaaaaaaaaaaaaagatctttgcagaacacctattaattaattaattaattcactcattcagcaacatttttgagctgctgccctgttttcatgatgtgctacatgatagatttgtaaacacctgtctcaataaacttatagttgtgttggaataggtattattctcagttgcatcttcatgaaactcataataaattggtaataattacaatgtaagaaggattctgaggccacagaaagaatgataaaaatgttataatctcctaataacatttccagtgggcatagtaggtgaaagcagcaatatatttgctacacattaatgcatgtaaaaagaaggtaatgttcctcaatcttaggacttaatgttactttattggtttaatactagctgctcttaaaaaatccccaaaatataatggcataaacataatagaagtttactttgcactcactttaagtctgaaacagatctacctaactggccattagctcgtctccaggtgg

SEQ ID NO: 10102 - DNA, 1290 bp, Homo sapiens
acacagctcttggctacggaagacccttaatgtttcattcttcttggatttttccccatggcaaaaacttttgccggtgagaggaggctgcaacaccgagcggaggaggcaggaaccggagcgcgagcagtagctgggtgggcaccacggctgggatcaccaccattgaggcggtgaagcgcaagatccaggttctgcagcagcaggcagatgatgcagaggagcgagctgagcgcctccagcaagaagttgagggagaaaggcgggcccggaaacaggctgaggctgaggtggcctccttgaaccgtaggatccagctggttgaagaagagctggatcgtcctcaggagcgcctggccactgccctgcaaaagctggaagaagcagaaaaagctgctggtgagagtgagagaggtatgaaggttattgaaaaccgggctttaaaagatgaagaaaagatggaactccaagaactccaactcaaagaagctaagcacattgcagaagaggcagataggaagtatgaagaggtggctcgtaagttggtgaccattgaaggagacttggaacgcacagaggaacgagctgagctgacagagtcccgttgccgagagatggatgagcagattagactgatggaccagaacctgaagtgtctgagtgctgctgaagaaaagtactctcaaaaagaagacaaatatgaggaagaaatcaagatttttactgataaacccaaggaggcagagacctgtgctgagtttgctgagcgatcggtagccaagctggaaaagacaattgatgacttggaagataaactgaaatgcaccaaagaggagcacctctgtacacaaaggatgctggaccagactctgcttgacctgaatgagatgtagaatgccccagtcccaccctgctgctgctcctccctgtgacccagactccgcctgaggccagcctgccagaagctgacctttaactgagggctgatctttaactggaaggctgctttctcctttcaccgccccctccttccctgtgtctttttcgccaaactgtctctgccttttcccggagaatccagctgggctagaggctgagcacctttggaaacaacatttaagggaatgtgagcacaatgcataatgtctttaaaaagcgtgttgtgatgtacacattttgtaattaccttttttgttgttttgtagcaaacatttgtaaaacattccaaataattccacagccctgaagcagcaatcaaatccctttctcacttttggaaggtgacttttc

SEQ ID NO: 10103 - DNA, 1141 bp, Homo sapiens
agcagggggcgtactggaaaacctgggttccctctcgatccttcacgaattaactgagtgacctacatcaaatcctagcgtgtcctagggccttggttttgccttctgtaaaaggaagaggctgcacaagttgtccaaaagtcctccagctctaaaattctaagggtctcctcctttcaggtccttagctggctttctaccgaattaaaaatttaaaacccatatgaaaacgtgagctagacaaaagaattaaatgtttgaacttcggtcggcctactttatgtttgttcaaaactgttgaccatttccgatccagtgcaggtgatatttcacgttcacagttgacagaaatctcttgaatttcagcctccgctaaggagcgacactgcgcttgtttatgcctagccagaatggaatggctgcggtatacacagtggtatttgccaagtaatttcattctttatattccccatgaaggccctccagagtggatcagcataactctatttagctgagatactgacagggctgggaagaaaccctgctgaaagggcggttacagttccaactttgattccctgaaggatacttataacaaccacatattagaccaagaatgcacagaaagagtttatctctggggccccccacaccacttatttggatagtgctttagtttgcaaattcaacttgttgagtcaaatttaaggccagtaacatctcatctatctgacatcacagcagaatgacatcccacttaaatgaaaaacttgagcggcctccccatcatctgatagagaacgttcgtgttttcttgaatgcagccctctgaaaattacttaggcttggtcattaaagagcagtgctataattatcaacattattgtatgccattttaatcagtgaatgttctctaaaatatgcaaaatttgtccctataataaatggcctctaggatgctggtttttgtgtttttgttttgttttgaacttctgtttttgctatctccttcctcactactgggctgacacttctctattcttctacctaacaaccttctttcctacttttttgatgcgtctatgccattatgaacttggacatcgataaacttttattagcttagactctcaggttttgt

SEQ ID NO: 10104 - DNA, 2441 bp, Homo sapiens
ttgtttatccattaccataaccaattttagagcattttcgttacccccaaaagaaatcccataacctgtagctatcactcaccaatcaccagtcctttctacccacccaccatgccaccagctctaggtgacccactaatctattttctctctatatatacttgcctacttttgacattttatataaatcgagtcatataatatgtggtattttgtgactgacctctttcacttagcataatgttttcagagttcatttttgttgtagcatgtatcagtacttaatttctctttattgtttttgttcctttttttctaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacaggtatgtagctctttgcttttattttggagatttgggggtagggcggactgttagtcattgggttaattttatatgaaacatagtcaagatttctcaaacttggtaattccattaagtgaacatacatattttgatataggtttatattgttttacaagtcttgtattgaaagtgattcactgatatgctcaaagcaatagattagcttctatatttagaaaattataaggtgttaagacttcttttgtgatgtttatgaatacctttgagagaaagttattttatcaaaaacaacttaataatcataattaaaagggaaaaaccagactgggaaaattttattgcaaatacaattaacattgagttaatattcctataaaaagctttataaattagcaaacttttaagacctcagttgataactagataaaacatataagctgaaattcacaaaaaggaaattaaattagtaaacaaaaccagaataatatgcagctttaataata

SEQ ID NO: 10105 - DNA, 1149 bp, Homo sapiens
tcagtgatagcacattgcatgactatttatttatttgcatgtcagcttctgtaatagatacacacccctgaaaggcagagaacatgttttatttcttttgtatcccatcttctcatactgtcctgagatacagaaggtatttattaaatgattcctgaacaaataatatattgagttggccttgcccttcccttttcttttttaaaaaatcagacatctaatgggtggtatccttattttggagctatagaaatctttgtgcctttgcaggtttataataaaattgtaatcttaagcctaccctgcacttaagcaacttttacatttttataaatgcaactattttatttgatctttgattatttttgtatatttatctttaaagtatagaaaaaaaacccaatgtatgcatggataatgtatttgtttatttcagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggtgtgttattgattattttgtttgttgtttgaaaggtcagggctgaaaaagataagcattacctaccaattattttcaaatttaggatacattttaattgcctacctagatcttagtttaagttcttttattcatcatttttattttacagtaaatttgagcagctgaagagaacaatgagaaaagtcaatttaatgctgtagttcactataatgaagtatgcagatttaaacaatgcacgagtttcattgtaatccttaatttttcaactagaataataattttactaattgtttttaaatacacattagatttatttttagggtattaactgtctctgatcattgtccagcttttttcccgtcatttaaaaaatttaaatcctcactaataccacaggcttaaatgcctgttgaggtgagaccataggttctctttcatgttcaatggatttttattttagacattt

SEQ ID NO: 10106 - DNA, 1166 bp, Homo sapiens
cagggtctagcacatagatactcaatatctgctgaataaagtatttggatggctaattattcactatttatttgctattatatttgtgaactcattggtgtaagtaataagaactaatactgaaatctcattggccagattttatcatgattatttcttgcccaaaattattataattcttaaaaattatcatacaacattttaccaagaaatacttattaggatacaattatgaataatataattatgttggcataatgtttaacaagattattgaacacggcaatataatacagtttcaatgataaaagttttcattgtaagggagtgtctgcatatgtaaaaatttcattagaaatgttttataacagatgttatctgatgccacttgacaggaataaaaaatatgcaattaaaatattccagcaaataattatatttgatcatttctaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggtaagtaacttaatattatcattatgacaattgagtttattagatgtatagtgaaaggttatagagttaatgctaaaaatttttctttttaattttagagtgtagtacatctgaatcttatctgtgataattgagattttttggggggccttaatttgtaagaaaaaaaattctgtttcctacgacttcaaattttttagctctttccttcaaaaagcattagtaattaatttttaaaatgagacctctatagagtatgtactatttaaaagaaaataagaccgtaagtttttgttttgtttgtttgtttgtttaagatggagtttctctcttgctgcccaggctggagtgcagtggtgcggtctccactcactgcaacctccacctcccaggttcaagcgattctcctgcctcagcctcccaagcagctgggattacaggcatgtgccaccatgcccagctaattttgtatttttagtagagatggggtttctccatgttggtcaggctggtctcgaactcccgacctcaggtta

SEQ ID NO: 10107 - DNA, 1211 bp, Homo sapiens
aagataatcactttgcagtaatgactataaagaattcaacagcattccagtgtattcttaatagattgcaatatagaagcaagtatgtcagtcgagagtaacatggattaaggacaaaagaaacattcatagccttcttgtataaagtttttgtgaaagtatttcttgcaaaaaagtaatatattatgatgagatcagcaaagcagtttttatagactgccttttgttattctaacttctgaaataaaatttattgtagtgttcttttacctatacatctgggaattcagaggttttgtatctttatattagtttttgttttctccttaacaccaacaccaaaaagtataaagtcacagaaactacttgagatgatattgcttcttaattttagagaaaacataatgctgcaggaaaactgactttacatttgatagaatatgtcttcagttttattatacttatttatgtaaatttattccatttcattccatagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggtaaataatttccttggctaacaaaaaatgcattttttaaaaaagtaaaattgtgtaactttttggtaatccacatcttttatttttatctggacaaactaatgtatgtttctctatgaaatatctgtgccaaataaaataggtgaagttattttaattgttatgataaaaactataatgacaaaaatttttacttttttatatgtctcactaacttatatgtcttactagcttataaaaaattatacctaattgagtacagtactttttgtttgtttatttagatatgaggtctcactatgttgcccaggctggtcttgaaccccaggactcaagcattcctcccatcttggcctccaaaagtgctgggtttacaggcacgcatcatcacgcctggcctgatatttttatagtttaaagaatattatgtaaacttgagagagacctaagctttaagaataatttatttgtaataaaattaaaatttcagaattttaatccttaaaaataagtactcgc

SEQ ID NO: 10108 - DNA, 1111 bp, Homo sapiens
ttttgtgtgtgtttgggaaaagagtttttaaaatgacaatgatttattttcctttatttcccatatcctgtgttatatttcctttaggagatattactatctgaaaatgtgatgaaaataaactagaaatataccagaaaattaactctgtagtgcaggcaggtttggaaattcttgttctctaacctaatttcttaatggtcttgtaatgtttttagaaaccatacccccattctctgtagcctccccaccaaaaagattcagtccttaccaaaagtatcagagttaaccaacagtaataacttatttaattctgctcctaaacttcagcctgtgtttgcattaagcctttgccttaagcagatgcagtgctgtgtttcagaccactgaatttgaaacaccctttgatgtatgagtatgcagaattcaaattctatccatagtaaatgtgaggagataatgttttaagtgtactttgatagatttttcctctaaaactgccattatatatttcaggcgagttttgtggcatctggaaaccggacagatatttctttagatgatcccaacttctggcaaaaatgggctaaaaaggcagaaatagatatagaggccatcagtggcagagtaagtatttttatccctctaaaataaacttgcttttgggatactttggcaatagtattgtaatattttaaggtgttcaattatgcagttactaaaacaaatttctagatatataaattgaagtagggtagcagaatgaactgagtgaggttctcctccaatttaatacatctaatatctcccatgatgggttatccctacagggaaggtttaacttttggatataatttacattcttaaaattataatatgttttttaaattttttaatgtcttcaaatcatgggttacatttattttctctttaatgttttcttagtgtcagaacccattaatgataatctagtaaaatgtaaataagaggagaaaaaaagcagtcaagaaagtggcattttttaaactgcttctcttatgacttcccttgagctaagaaaaggtcaaaatgctaaaattcactttatggaactgataataatagcataact

SEQ ID NO: 10109 - DNA, 1199 bp, Homo sapiens
aaacatggactatgtgaacatgaagagtggcagtacgtttttgtagtttttaaatatttcacaacaaataactcaaagaactaaaatgagtttagctatcttgaagaggatggctaacctaatctatctaaatcaattttgaaaagcaagagtagaggtcaaaacatatcttttagtatctaggaaagcaaaagtaaagcagagggcataagtttgatcttttgggttttatatttgtaaaaaaataatctgttttggaacaaaaaggaaatcagaatgattaatatgagatgtagaattgttagctatttgggggaaatatgttttaatatgtataaaaccatcatcttgatttgtggttgggtcagtattgttactaatattttaaagatctctgaacagacctcagaaagtctccagaaatttcttgcattgaaacaatctttcagattgcaaatttttatacaaattattcctaatttatatgtccttattttaacaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataagtaggtatagggtattttaaacacaactctttaaatgtttactgttctgaatttattaatactctttaagcttgctgattttgagtacagagacagcatggtctagggccaatcctaatcctaattttacaaggtatcctacaagcaaatcatgatacctcttgtgtcattgttctcaccaacagataagtaaaactggcctccaaatgagctcattatatcttacttgtatatgaaataatgatgattatgaagattttggagaagttctttatatatatggtagtaataagattcatttaatcagaagtaatatttcattattttaaaatctgtacacaaattccttcctaattttaaccccatgtccgaatattttaaacgatgaatgtctttatgcctttgatttattttcccttgtttttagggttttgcttcgtgtgagaatgctgtattatctaaagcaagaagttattggaaatgagtgtcagaaagtatttgatggagttgatgcaaggtaagttaaacaatttttat

SEQ ID NO: 10110 - DNA, 1152 bp, Homo sapiens
attaaaagtaaattttttttttttttttttttttttgagacagagtctcgctctgtcgcccaggctagagtgcagtggcacaatctcggctcactgcaagctccacctcctgggttcacgccattctcctgcctcagcctcctgagcagctgggactacaggcgcccgccaccatgcccagctaattttatttttgtattttttaatagagacggggtttcaccatgttagccagtatggtctctatctcctgaccttgcgatccgcccgcctcggcctcccaaagtgctgggattacaggcatgagccaccgcgcccgacccattaaaagtaaatttttctaaaaaaaagtatggttggatagatgagttaactagcatttaaaaatgttttacaaggcagcaagcttgtatttaatcctatagtgttaggtacttgaaatgttttaagtttgtattatagtcattatatttagtattaatattaattttagtgactagtgtggtttttttctttaatctgactcaaaatagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaaggtatgtataaaatttctttttcctggtttcggtcaaagaagcaaaaatcactaaaattcggaaatttccaatttgtctcttttatgtgaaatttcaatactatctaattcaacttgtcagtaattttttagaattataaataaactagcttaaagatcgcgtatttgttaatcctgctattaaaacgagatctaaagagaataaaggtatacactgagtcttaagaaaacaggtagagtttagtgatagatttatgattaggaggtggtggaagataaaggattgcttttgttaaacagaactaacctatattttcagtccatcttataggaattgtgctagagggtttatttacctgaataattttgcaaggaatgaagcccccactcataagacattttaaagaattttctaga

SEQ ID NO: 10111 - DNA, 1704 bp, Homo sapiens
gacaaatgttattaaatgcatcgctcatagggaatttcttaaaattcccagttctattaatgtacttccaaaataatcttatgttttacattaacatccagtattttatgttacatgatttttagtacttacttttaaaactttctcctttttaaagcttttactgaaatttcaaaatttcaaaatcctcactgaatttctcctcactgaaaagaaattctggaaactatacagtgatattgcatggaggcacattttagaaatggtattgttataaatatataaagatgtatttataatgatttatttataaataaaggatttttgagattaatatttttgtccttgtttcaatatgtagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgaggtactatgcataaaataattctacttttttaacataacttttcttttcttttcttttcttttcttttcttttttttttttttttttgagatggagttttgctcttgttgcccaggctggagtgcaatggcgcaatctcagctcacttcaacctccacctcctgggttcaagcgactctcctgcctcagcctcccaagtagctgggattacaggcatgtgccaccatgcctggctaattttgtatttttagtagagacggggtttctccatgttggtcaggctggtctcaaactcccgacctcaggtgatctacccgcctcagcctcccaaagtgctgagattacaggcatgagccaccaggcctggcctaatataacttttcaagtgaaaatgaaaagaactcgtttcaggtaacttaaggatgtttaaaattgttt

SEQ ID NO: 10112 - DNA, 1203 bp, Homo sapiens
attaggagtctgtattactttttaattataacagcaaaaataaaactatctttgtggtataattttttgtctgtttgtttgtttgtgagacacggtcttactctgtcacccaggctggagtatagtggcacaattttttaattttttgcagagacagggttttgctatgtttcccaggctggtctcaatctcctggcttcaagcactcctaccaccttggcctcccaaagtgctgggattacagacaggtgtgagccaccacgcctgcttatggtataatatttttgaacttcaccaaagggaatctgtactcaaataacttgttgcagaattgtaatatatatatacacgagaatatgtatgcatagcacatacacatatgttgaactagggttaaatccatagactcttgagctatttgatctccaaaggtctgatctaattattaaaattacactttgatgttgcacgcttttctaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggtgaagaagcatgtacgagaaaaggagtttacagtgaaaatcaaagacgtatgtgtatttttattgccctagggcctgattgcgattgcggtgtgcagcatgcttttcctgcaaatggctgcctgctcttactcttccttccttcacatacctgtttcttggtatttggattattttctttctgatatccaggttattaaacttgaatattctactagagggatcgtcattaaatatgtttttctctttatgcttctgaaaatagttctaatcaaaatgctttcttaaacagtgtggcaatttctaattgttttggttcttttatatagtatttaaatagtatgtcagtgtactttctgttttaaacatttagcatgccctgttatcagtattgtttcatttttaaatgatttttgaagcttaacttattacttagtgtctaaaacatagttaatgtcctccaaaatgtcatatgaataatgtacatagagatgtatg

SEQ ID NO: 10113 - DNA, 1163 bp, Homo sapiens
tttaatttatctgtgttcctctaaaagtgtgatgtcaagaattgagaatgaaaatttaaaaaaaaaagttgagaatggtactcaagattaactgagtcttaatgcgtggaccacaacatactgatctcctaaagtactagttgtcaattcaagcaaataagtgtcttgaatttcccttccttgtgcataaagttaaagactgtacttcagtattctactaagtctagttgccaagcaatacatgctgtattataagtgttgtcttgaactgatcactatttccaaatgctgctattaccacttcttaaattataaattagtttagcttcatcagcatcagtttggtctcttgtggattcattaaccattcaatgtaattttccaattagtagaacttcagacatgtatgaattgcacttcaaatatgaatcacccatgcttctattactgtagaataaatcccccaaattatgctttacaattacagtcgcccaaattataccttacaattaacaattttgttatcaaaggagccctttttttttttcaccagaaaatggtaacaaatggggaagataagctgtgcgttcttttgcccaacctcagtggggcttaataataccactactcttactgtttaaaactccactgtaaagtgagattgatacttctattgcctgaacattttattgctgttgcagctgaagattgtatagcttttgcctgtaagtcattctttggtaaataatactgttttttaataatatcaatagtaggggtccggtgtggtggcacatgcctgtaatcccagaactctgggaggccgaggcaggcggatcacctgaggtcaggagttcgagaccagcctaactgacatggtgaaaccctgtctgtactaaatacaaaaaaaaaaaaaaattagcgtggtggcgcgtgcccagattcccagctactcaggaggctaaggcaggagaatcgcttgaatccgggaggcggaggttgcagtgagccgaggtcgggccattgtactccagcctgggcaacaagagcgaaaccctgtctcaaaaacaataataataataataataataataataataatatcaatagtaattgtgccaagcgtggtggctcacacccgtaatcccaggacttgaggaggc

SEQ ID NO: 10114 - DNA, 1097 bp, Homo sapiens
cctgggcgacagagcaagactccgtctccaaaaaaaaaaaacaaaaatcaaaaaagaataatgtagaaaaagatatttggcacaaaaagcagagataaatgattttttttaaaaaaacaagcttttgaaagtataggaactaatgggttcaaagaaaggggaaatgtttatcttagggaaaaggcatgcttccttctccaaggaaggaagagaaaatgtgtgaatatcgggaaaaaaaatagagaagacaggtcaaaaattgaaagaggcctaggttgtaattcttcaggtttttaaatgagaggtggggatgatatttttagtccaaaagtttctacattaaagatgtataaaataagaactaacactttcatatatttaggaaagggattactttcagtttgtttaagaactaaatttgtatcaccattttgcatttttaattcaattaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtaagtaaagcagtacttaaaaactgatccttgaattcaaaattcaatcctaataaatatacatattattgttttgtgaatgttttatagactattagtaaggaaattagaagtatgccatataattttagatgatatcttagaatcttagcactgtccaagagtgataaaaattttaagtttaaaagatttagcagaatttttagcaacaacttattttttctcttcaaaaataattgctttattgaaccaatattagaatgataaagtatgaaaataaagataccatttggtgtttttttacaggtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtgg

SEQ ID NO: 10115 - DNA, 1173 bp, Homo sapiens
agtttacatttaaagtacttagcacaatacttgccatataataacttatatttattatgtgacaggcattatgctaaggtacttgaattgtctcattttatctttataaaaccctatgagggaagtattattgttatccccattttacagatcagaaaattgaggctgaaagagatttactgatttgctcgagttcacatagctggtaagtctaactctagagggtgtacttttaactaggctatatggcctgtccagcatggtagttattcattttactgttctagttattctacttaaaacatttaaaatttacattatcacatatttatatattacatcagtagtccatagggtcacggtgggcctttttaatataatcataaagattacctaaggtggttcaaaaaatatgtattttaaggaaataaactctgtagagcatacaataaaagcaatcaagagttttctatgtaacagtgttgtagtatttaatctgtttctaatttacaggttggaggtgcatttgctccccctttgaaagatttatgtagattcctaaaagaaaattcagaatatggagtagctcctgaatggggagatgttgttaagcaatctgtgagtattttacgaatactaactcatacattattttcaaattaggtgccattcaattatatcttagattaattataattaataaaatattccatgaatttgtgacagcatttttcagtttgcaatttttattttgcagtacatgttgcaaatttctcagatgcttctcaggttagaacagaaaatcaatactgatttgtttttacattaacctctaagataccatttgaatgatgccacaaagagtaatcaaatatatgagcaaatatgtaaggatattcatcatgatatactagtaaaaaattgagaataaattaatagttcattaagattctggaaaactatgcaattttttttctttttctttttcttttttttttttttttagacaggatccctctctgtcacccaggctggagtgcagtggcgcaaccttggctcactgcaaccttcgcctcctgggttcaagtgattctcatgcctcagccttccaagtagctgggacaataggtgccaccaacacaccctgctaatttttgtatttttagtagagac

SEQ ID NO: 10116 - DNA, 1699 bp, Homo sapiens
ataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactacccatgatgtcagcctctgtacatgagaatactttttaaaattgaattttatatagaatttatcttattccagttatgagagacaccatagttgtaaatctttaaaaggaaaatataccgtggaagaatttttaaaacaaaaattggctataattttatccacagtatcttaaatgctgtcaatttttcattttgatttaattttattaatattgttcattgtggatattggtgactgcaaaaaaagcaaaagctgcttcttgggcattcaaattgttaaaccccaattttgcagcccaatctcaacttcatgctgaacattaagtattattttcttaagtttttggacttttaaaaaactcagaaatactcagagatattcctcacctctttaagaagtccattttggaaatcaataattatttttttcccttagtcttaagagtgtttcctaactcatt

SEQ ID NO: 10117 - DNA, 1132 bp, Homo sapiens
gggcaagaataaattgtaaactagtatgaaatacatctaatacattcaaattaaagtatataatatctgaacagtgtaatttttttaaagtggtgttttttgtttaaaagtagacttacttgcaaagttgtattttgtggtttttagatcttagtatcctaaaatttgatatcctaaaatttaagttttaagtttcccttaaccatctctacataaataattgaataactgaaatctttcgagtaatgatacactttacttctatttgccattttttgacaaattcttagcgttgaaataggcccatatatactgtttcctatacatttgtatgctaagtggtatactgattatactctatgttttacattttagtttattacaaattggcttattgtgtgctgatatctctgttttgtgattctatacaccataggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaaggtttgtaagtagcaaagaaataacgtgaaaatgttttctggagaaaaacttgatttaacatgacgacttaaggatctcttctttcatcatagctccttaagggaaaagaagaaaatctcactgggtttctagaacctgggaactttggagagagtttgtgagtacttctgtataaaatgttttaatattttaaattgtatacttaggaaacttcagaagttagtgtttttattgtttgtactctggaaactgagaatatgttttgtgagagaatacagggaagcaaaaattctgtcacctaaatataagcacactttttaaatgtgttcaaaattgtatggctgtttttgaagtttctttaagcttctggattataaattttgaaataaattcttttggaactatatgggtgaaaattgatgatgtgtaagtgtggaagtcttcaggggtgcctagagcagctagacagatagttaagcttctcaccggaagttgcacctaccagcagctgaaacactgtcagcaaaatacttgt

SEQ ID NO: 10118 - DNA, 1524 bp, Homo sapiens
agttatgtgagaaaattaattagataatgtctaaaacatacatgtcgacaacaataaaaaatactgtgctttattaagttaggggaattggcttaaaactgcaaaatgaatgttatagaaatttagtgagccaacaaatagtttttaaatacttttctcttccttaagcttttctccatggaatccttctgtacatgatgaagccagagaaaagatgctgactcagaaagtaagtggataacaacttatgaaatggctaactcattgtttcttttctaaaatgtcttcatttggagactgctcattacatacaagtaactttttttgggaaacaagtttgtacagtgctgaaatctcctcaccagtaattttttaaatatctgttttgattgtgcctagaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgacttgaaaactgctggaacaatagtgattaataaa

SEQ ID NO: 10119 - DNA, 1130 bp, Homo sapiens
tggcagtgagctggcatcatgatgaaaatctggtggacaggtcagcggtggcagtgtacagttatagctgtgaaggtacagtctgctcttggaaaaagcagccctgtatgtaataatatgacccgagttgtttaggctctggagatacacacgcatatacatgaacatgtttgcatgtgtgcttgcgtgtgtacatgcacatgcgtgtgtgtgtatcatgtgtcctttttagtcttgtcacacctgtatgtctgcagaatatgcctctttctcatctggccatgctagctggctcattgttatactgtactcagaatattttcgcacgtaagcactgctgtcatttgtctctcttgtgcccaggagagcagcctcttggtttcatacagccgactgtcttctctacagctcagaggagattgtacagttgctataattaacttgctgataaagagctgggaaaacaaaaatctgtcaaatctttccaggttcccacaggtgcacatttccagacctgccaaaatattttattatggttgacatcactatcttgatgggtgtgatttgtcaaatatggacttgttcttggcttcctatagtttgtaactactgtccttccttgccagaagcagttgaggtaggttttgtaagcagacagtcctctattttcaggaaactccctagctctttacccaattctgcagttttagaccttgttgggtggctgtggtagacttgttcttgcattttctgatgtataatccccttgaaacagatcgtaggctacctcttagtagcccacccacatttctcttcttctattattgtttctgtgtgtttatggccctcatttttccttagaatagaattacaaaaatggtagttgaacagatggaggagagcatgacctctgttgactttcttttgtgtctgattatttggcaaagggatacaagacatagtattagctctcctgtctgatttactgaaagatgtttggaaaaccagaattctggatatcccatcagggaatgactggaactttccagggtcattattttctgacaactctagttatttgattggatttttgtttgttgttgttatttgtttactaaaattactgtttt

SEQ ID NO: 10120 - DNA, 1200 bp, Homo sapiens
caggacgaccagcacacaccactgccaatttatttttaaaaataaaaataaattggccaatttattattaaaaataaaaataaattggccaatttattagtagcttggccaatttatttttaattgttttattagtagcttggccaatttatttttaattgttttgtagagacagcatcttgcaatgttgcccaggctgggcttaaactcctggcctcaagagatcctcacgtctcagcctgccaatctattaggattataggcatgaaccaacacgtctggccagacctcagttttaagactactcttttcttagctttgcagatatgctctggagatgccagcttacactgggaactggttaggctgacctttctcaccttttctcatcctatggccatcaagttactggaggagaattaagagacgaagtcattgtcctcgcttgtctatcacaagggtattaaaaccaccatcttctctttatggtccacaggtcgagtttgagtggctgaggcagttttggtttcaaggcaatcgatacagaaagtgcactgactggtggtgtcaacccatggctcaactggaagcactgtggaagaagatggagggtgtggtaagtccatcagacctgggaccgtgttttctgggctgctgtgttatacaaatcctccactgcctcatttgcttaggcaaatgtagatttaattattcctaattatcaagttagattcttcttggtaaggtgatgggtatagccaggattttgtcagtacaacctcagtttagttcaataagcatttattgagtattttctcctcatagggcatgtgctggacatatactatgaagtggtgataagaggataacaattcgaaaataatatttaacattcatttgcatttttatatgcatcaggtgctactctgttttctcagtattaactttaaaaaatttttacagcaatgctaagaggtatagaaacttttccaggccttaatttgtggatgtgaaaactgaggggcagggaaatgaagggcctcccccagggtcactgagtaagtggcacagcaaggtggaaactcaggcaggctggctccacagcttatgctctcaaccactgtgtcccaacagttgaacaaggagaggggcacgaatatcaccaggtatgacattagctaaattgaaatctggtaatag

SEQ ID NO: 10121 - DNA, 1138 bp, Homo sapiens
attcttatctcctgactggttctccttagagaattctcaaagccttttaaaattgtgtgtttttctggggcagccttgaaagtcccaggagtgaagttgccatctgtcctttatattaaaagaatcttctgtattgtatacctgatgtgcttgtcccagagatagatattgttaattaaaggacagcatttgtcctttatctgaaataactctcttgcctgaataacagtttcccaagccttaggaaacaggtaaggacattcggcccagagccctgatgtttactaaaggtccttggtccaggagctgtccctcagccttcactagatcagacatgtagactagaaaattacttgcttattttttggggggggcttgttttctattaattcatctaccaacattatggccttttgcatgcgtgtaagtaaatgaacataatatatactgtcattggtagtttgtgctttttttgtggcgactcacaaacagcgagttcccagacattctcaccacactgcatctttatgcaatagatgtgacaggacctatatcctccagtgtcacctctctactactgcacactctctgtttctataccttctgcccctgggaaaagaaaaatgcaaacatctgcctacagcaaacagagccagagttctgccaggtgatagctagaatatgtatagggagaaagaaagcctcgcccgtaacctgctctatctctgtctcaggaaacgcagaaaataatttgtctctgtaatatagaaaagcagttagggtaacgtggctgtgaactgctgcctaaaagtgtgctgtgtgctcgcctctgtagttgctaagcacggaggaggaggctagccagggccttgccacagactaacttcaagaaaagaggaaaagagtgcaccagcagactctggactgaggagcatgtccaacggaggaggcgaggtgtggccaatggttcttttgttgataagaaagaccctgaaattgcctgttgcatggtgaggagagtagtagattggaccgtaattttctggtgacctaacaaaccaaactaaagctcaagtttaataggcaatgattcccgtttaaaagggaattcaaattatttacagttctccatcatcat

SEQ ID NO: 10122 - DNA, 1177 bp, Homo sapiens
tcctggcctctggaaaccagctgaagcagtgggccagctggtctatcttcaatcttgcataccaacatctttctctgattcacagatttcctttatccccagcacttcctctggtatgtgcatccccgaaagtaagtgatatctattattggatttgggcgttttaaaatcattagccttctggaggggaggggagaggaaggaggctggatggttacattagaatatttccagagggaacctcactttaatctcatccacctctgacttctgcaccccagataacccccatatttgggagggatgacatcacagtaactgacaatggaattatcaccattgctctttttaatatttaaatgatacacagactcagagaaaacaaaatgagtttacatatagtcataatatccataactagagatataaaacaaaaagctatggagattcttatctagtgaagaaatctcttttagaaagtttctgatgactttcagttgcaaagcatagctctttcacaatatatcaacccactttcaatgatttgagatttggagagggcccagccatagatttacctggtgagtcacagagtagaacttgatatgagaaagcaggaccctatatctatcagcctaatggttctcagaataccaggtcatatccatcatttcttttcccaaatagctgtaacaggcatacctcgttttactgggcttcactttcttgtgttttggagatggtatgtctttacaaactgaaagtttgtagaaacctgcattgagtaagtctaccagtgccattttttcaacaacatgtgctcacttcgtgtctctgtcacattttagtaattcttgcaatctttcaaaagtatttattaagataaaaaacaaaagaaacgatataaaaataaagagaaaaaggaagaaaatttgttattattatacctgtcatagtgacctgtgatccgtgatctttcatattactattgtaattgttttggggcacaatgaccctcatccatataagatggtgaacataataaatgttgtgtgtgttctgagtgatccaccaacctgccattccttcatctctctccctctcctcaggcttccctattccttgagacacaacagtattgaaattaattaataaagttatagcgtcctccaagtgt

SEQ ID NO: 10123 - DNA, 1549 bp, Homo sapiens
tggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagag

SEQ ID NO: 10124 - DNA, 1211 bp, Homo sapiens
ggttttaagtagaaaattcgcagatactacttgttctgttcctttatagcacacctgtcctgatactgacttggaaagagacaagaagactttggctgaccccacttggaaacaataggcactaatcccaaaattgtgtattgatcccagaattctcaggaaaagaaaaaaaaaatcaatacatgccgcttccagggttctcagccttactgtggggctgtcctcaaaagtctgcatcactgggtcaggtcttgacttctctctcatctctcttcctgtctttcaaccctctctcctccctgcaaccctcagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggtaaacctccgggcgggggttgggggtggagggtgaggaggggggaggtcatgtagcctgggatggaggcccagggggtgggaccagcaagatctcatccagccaggagtgctggagacgagggcaggaaatgggagtgttgacctggtcttgggaaggcagagcagctctccaaggggatacttggataactcttccctatccgaacaatgctaatatccatgtcactcttagcgctccatttctgggtttctcccattttctaggtgagtaaggtcacctggtgcaaggttacacaggtttgagcaacccagtggagtttagaatccaggagaatagccaagtacaggacagaattttccatcatgtggaatgaccttaacaatacgggggtggaagtttctagttttcataataagctttgatttttagtatgtagtagaaacagaacaaccagtgccttaagccaattatttatttatttatttatttatttatttatttatttatttatttattgttggttcttacagtgaggctagagtttaaaaagtcagttcatttttaaaaaatatttaatggtccaggtgatatctgagccaggccaaaatagtgaaagtggtgcttgagtgatgaagtttggggactgctagactcaggaaaaagcccaaggtctgccgtgaggggtgctgggttcaaatgtggcctctgcccttcactagctgcaagatattgtgtaagtc

SEQ ID NO: 10125 - DNA, 2243 bp, Homo sapiens
cagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcgtacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttttttttttttactctttgaaagctttgttttgtggtagtccttttgggaagaatccagtattatccacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgatttttttttttaatttgttttgctgagagcatagctatttgtttttattgtaaaacaataataataataaaaagcaaactctattggtgtgttgtgtgtggctggaagctaaggcatgtttttgtgtggctggaagctaaggcatctttttccagaggtgccaacgttaaaccccattttgatttggattttgtgtatactattttggttggagggttttttcccatgtttttgaattgggaacttttgtttttcctagtagtgtatttggggaaggcagaactacatttttcttccccttgtatttatatctttttttttttcaggtaagtgtgtagcgaaagattattttactgtcctcgaattacattatacttcacacgttgcacccattgtaggtgccactaattccacatgttcacaggtttctgatgtgtgaaaagagaaaattacttggatcaattttagagggtcttgacacattacaaaacagccatatcacagtgtttagagcaggagcttattaagtagcttaaaatgatgcaagaagtgaagttctcagtccgcccttccattttacacctggatacttgaggatttcaccacttcctgggggcgtccgggacaggtgctgagggcagtggcagttatgctgggggcttcccctcccaggaccacttttgctgccctgccagctgcagggtcaggcagatggtcctcacgcccagcccctggagaagcagcactcagggctgtggg

SEQ ID NO: 10126 - DNA, 1292 bp, Homo sapiens
ggttgtgttgtgttattttttaatttgaagaattttttttacaaagtctaatcttttctattgtgtaagaatctggaaggtagaagtagtaaaaatgatagcccttgccattctttttcattgtgcattaaaaatgtaagcatttttttcttttttttgagagaaggtcttgctctgtcacccaggctggagtgcagtggcatgatgatggctcactgtagccttgacctcctgggctcaagcaatcctcccaccttagcctcctgagtaggtgggactacaggtgtgcaccaccattcccagctaatttttgtatttttttttttggtagagatggggtttccccatgttaccgaggctcatctcaaactcttgagctcaagctgtctacccacctcagcctccaaaagtgctggggttacagatatgagccactgcgcctggcctatttcttaatatataagttactaaactaatatcgctatcctttgaatagctaacattccataattgatttagggttatagtccaaagtttacagattagtttctgggtgtcttacctccattcttcagatggctgctttttttttttttttttttttttctgttttcttgaggacaagtattagaaagccaagtgcagaatatatcttccatagaagccggcttttgttatggtaacttccctcaaatggggtaggtgtgatggtactcaccttcataaacatttttcttttttagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatgtgagtttttagccaagctttttgcttgcttagtcaccacgtttgccaactttgaattgtgtaatgtgaatgagccacagcaggcatggtcagggtagctcttctgggaagacttctagatcaggcccccattgcctgtttcttgaagaactttctacagcagccaagagatgcagaatcgttgtctcctggggagctttcttcccaaccccatagtgtttacttactgctaacatggggtcacttcacctatgcagactgttttgttcacagtgcaaggaaaccttgatacataaacaataaaatctggtcttttctagatattttctgttctagtctccttctgtctctcccagcttactctggttcgtggagctcttcttt

SEQ ID NO: 10127 - DNA, 1490 bp, Homo sapiens
aataatgcatataaaatgcttacaacagtgccagtaatctggtacatacttaataaatgttagtgaaattggccttttgtgaaagcttattgagtatgaaattgctctttctacttcgtcactaatcaaaccttatcttttgccactccactttggcctcctgataggttacaagttgaaatgcatatggggggaaaagagtcatattatttattcaaacacctacttgtcaagtgcaggaactgtgctgagtagtcagagtataaggacatgtagaaacttttcctgccttaaagaacttattagtggataattaatcaaatttatagtcttaattttttttattataagtattcaacaagtgtttttagtgtgtaagatgtgaccagtgagggaaaattggtgtagaaaatgccaaacgtggtaaaaaggcattcgaaggggaaaaaaagaaaatgccagacatgctaagggagggcagaaacatccagataaatttatttatctaatatggaaagtagtatgtactgtctttaataaaggtattgttctttttaaaattcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgt

SEQ ID NO: 10128 - DNA, 6290 bp, Homo sapiens
atctaaaactatcctaaaataaaccgtttatttaagaccaagaagaatgcttttaaaaatagaagaaaacatgaggggaaaaacaaccaagagttgaaagttacagccagtgggaatgggtgaagcaggacagagaactgcagtttctcaccatgaacattgtagaactatttttggccacttaaaatatgtagagtatgactttggttaaaataagtttagtgttctgctatacaaattaataaaaatgaaagctgaattttgaacacaatttttatgttgatactagcttgccagttttgaactaatattgtatgtcttgggcagagtgacatctatattaacaaatcatagaaaatctgtatggaaggcatattatccctatgtttcaattaggagcactgctaagaattttctgttcactgaagaaggggatttgtgagtacatatatttagttgtttactggcttatttctttttgacagatactgggtcgtcaggatggagttttgcaagactgggtcattgacgattgcattggtaactggtggagaccaaattttgaacctcctcaggtcagtgttcagttacatttgctgggcattttggaagcagaaagctcgtttaattctagccactttaaaaaagattaaagtagaatttgacttgaaattttcttttcttccctccttaatttaaattacaaaattaagccaagcacttcttattttaaaggaaaatgtaaaacaaatacaaggccgggcgaggtggctcatgcctgtaatcccagcacttcaggaggccgaggcgggtggatcacctgttgaggtcaggagtttgagaccagcctggccaacatggtgaaagctcgtctctactaaaaaatgtaaaaatcagctgggtttgatggtacaagcctgtaatcccagctactccggaggctgaggcaggagaattgcttgaacctgggaggcagaagttgcagtgaaccgagattgtgccattgcactccagcctggacaacagtgagactccttctcaaaaaataaataaataaatagaacaaatacaaaagaagagagaatggtaaaagtgaatgaattgcgctacccgtcgtctgcctttaacagttagcacatcacaacccctcattccaccgcttcattctcctaccctcatcttggattattttgaagtgtatcctagctattcatttcaattgtaaatatttcagtgtgaatcataaaaataaggatctctttaaaaagataactatagtactgttattatcatactaaaaataaacaattccatattattgtcaaatatatagtcactgttcgcgtatcctgattatttctattttctttttataatttgtttggattaggatagtctctaaagtctcttttacacacttggcaccttttttttttccttgtgttttatttgttaatgaaaacaggctaatgtttccatttcgattgcattcccctgttgttgttgaatatgtagctgtttcccctgtgtgtcttgcaaattgatagttagatctagaaattgtattcaggctcagttaatttggggaggggtaacaaggcttgtcataggcggtatataatctatacctgcataacaaattacctcaaaatttagcagcctttaggcctctgggagttgcttagggtggttctggcttaggctctgtcatgaagttacagtcaagttgtcagctgggactgcatcataaggtggaactggggttaaagtatctgatcccgagcttacacgtgtgtgtgttagcaaacttcttagtttcatctgggctgttagactaaagctttgcttcaggtgttgctggctgttgtctcaaggtctccctcagttccttgccatgagaacatctctaaaaggacaactctcaggcagctggcttacccaaggctgtgtgatccaagagatagtgagagacagagtgctagaggagtgcccaagtaggaagcctcagtctgtgataacctaatcttggcagtggcataccatcacttctgctgtgtgctattggtcacacaagccaaccctggtacgctataggagggactacacaaagcagtgaataccaggagacaggaatcattgggggtcatcttaaggcagtctatcacaattggtatagtgtacttccatcaggaatttaaaaatatttggttgtttcttgttgtaatgttagcagctcattgatgatcatttcctggtctatgaattcataagggttgtgatcctcatataaaaagaaacttatgtattactgaagtgtgtggtttgtgtagaaaaaaaaaatatgctgctattcctttacttaacatttttcagaagaatgacttaattccttagcatcctctaaagacttgactttattcaaaagagagggtaagaccaagacttgggtacaggcagtttgagaggtgattccaggaagcagcagaatacaggggagagagagaccagaagcagcagaagtaagacagggcatgttattgatctttttacacctgtgggcaactggatttgttctgttaaggaccaggaaccatgtagggactcctataccccattggataagggttgcatgaactcccttgcatttccatgttgagtcttgagtgcttgttgagacagtggcagcaaacagggaaccctctgatacttttcaaacatagctgccccgaaatcagaggtagcgtaatgtggggcacacacacacaaaaagcatgtttcagtgacctttaaagtgtcagtatgaccttttggatttaaataatttgaaatattttaatccatgataatgagtgatgatgttactgatgctcaaatattcctatttttgctaatggtggaacttcttaaagttggatcctgaattctttaggcaaattaaaaagccctatgactttatagctcctttacatgacaagatgtttcaggtcaagcattgcacaaaatatcaaccaagcaaaagatcgttcttttctcttgcttctgactcccttgtatggcagagggacaagaagataggggctgtggaagctgatgctggtgttcactacctaagaattgccaggaacacatcttggctttaaggaagaacaatttcatatggaaacagtgaagttacttgttcaaagatacatagtacagttattctaaacttttttttggcttcctgaacatgccttgatctaattggaaaatgcttagtagtgaccccagtggttttccagataacttttctgaatatcttcactcatctcccctaccactgtcctaggacagttctcttcattcagtaaggcctagagttggccctggtggtatttgacataaggtaagtgtattgatttatttaggaagcctagagtattagttagatgtcagtggaaaaggagcatatcatcttcctatctcagtctttttgtataaagtacagtcaacttaaacattaagaccagagaagaaaggcttaaaaaaataggaacatgtagccttgagcagaagaaatttggggaaatgctactcattttgtttgatcatggtttgggaacttttattgtatgtgatccacagatctcttagcttgtgctattcaggccactttctctgtgactgttaatgtatctggttttcatgacagtttaaggaacctccaaagcctgggacaattgcctcaattcattgtaccctagggatggctctgatatataattattctaactggaatactggttaggtgccaatgagtaacacagtgggaaataacataggcttttataattagataagagttgaatagatacagttaaatcttggcttcacaacttggctgagtaatcttgggaaagatacttagcctctcttagcatgtgattctgtgtaaattgaggatgatgctaatacctccttttggcagcttctgcttttatctcactttccccttatatctgttttcagcaattttaaattccccagctctcagatacaactccaacagcaaaagtagatttctgaatgtattgtggagagatttatacaagaattgtataacccttagactttttttttgttctgtgtcagaatttttccttcccgggtagcaacttccctctctaattctcttcatccctttaaattctctaaaatatacatatatattatatatatatttttatatttgtttcctcgagtaatttggctttgcccatctggcaaaacttcacttagactgctcttctggtattcctgaagcatgcaccttggcatacggggaggtttgaggttggggctggaaggaggagcaagaagcatcttgtcaaatgcctcacagcttatatttgaatttttaatgtaaacaggtctacaacaggattctagactgtttaacttactgatcatatatatatatatatatatatatatatatatatatatataatttttttttttttttgggagacagagtctcactctgttgcccaggctggagtgcagtggcatagtctcggctcactgcaagctctgcctcccaggttcacgccattctcctgcctcagcctcccgagtagctgggactacaggcgcccgccaccacgcctggctaattttttgtatttttagtagagacgggatttcactgtgctagccaggatggtcttgatctcctgacctcatgatccgcctgccttggcctcccaaagtgctgcgattacaggcgtgagccactgtgcccagcctatatatatatttttaaaaaaccagcttttaggctgggcatggtggctgatgcctgtaatcccagcactttgggaggccagagcaggtggatcacctgaggtcgggagttcaagactagcctggagaaaccctgcctctactaaaaatacaaaattagccaggcatggtggcgcatgcctgtaatctcagctactcaggaggctgaggcaggagaatcacttgaacctgggaggcagaggttgtggtgagccgagattgcgccattgcactccagcctaggcaacaagagcaaaactctgtcttaaaaaacaaacaaacaaaaaaaagcttttattaaagatactaattaaaatcggacttcattatgttttaagtatctcaagctataaatcctgtgactacatattttatctcgaatggttgactggtttactgcttgttattttatatgcattaaagcatttatttactagtgtatctgttagataagtcctggtaaagaggacagaaagtagtatgcttctcccaacagtttatactatactggggagtaaacatgtaaagaaatgaagccatggaatacatattaaagttgtattcatttgtaatttcagtatccatatattcctgcacatattacaaagcctaaggaacataagaagttgtttctggttcagcttcaagaaaaaggtaagttattttgttttcaaaggtagccatctaaaaattctgtagaataatttcaaggatacctctatttgtgttttctcaaagttccttgaacttttgggtttgttgtaaaactaaagatgtataccatgcttttagtttcaaatctgtggctaggaaatctaccttgaaagacacaaccaaaatgtattaatgagaattatcttttttcttacactttttattaaatgtaaaattggtaatttaaaaatgaaatggaagcagtgattatataataacttataataatgaattctgttttattttagccttgtttgcagtccctaaaaattacaagctggtagctgcaccattgtttgaattgtatgacaatgcaccaggatatggacccatcatttctagtctccctcagctgttgagcaggtacagaaagttgaacattttttggttcatccatattaactgtcaaatttaaaatattctgagccacttgggaaggtatagttcatgaattttggtctttaaggaaactaagaaagtagatagactcttagatcatgtgcaagccatagattaattgtgactaataccatccccagactcttaagtttcggcatgacattctggtatttgtgcaactgctcttccctaattctgatattctcaagagttaaggttgatgtctttattcaaaaaagagatggttaaatagcagtcaacagtgtgtaaatatgagcggagttgtctgtattaaaatgtggcaaattggctggatgtagtggctcatgcctgtaatcccagcactttgggag

SEQ ID NO: 10129 - DNA, 1194 bp, Homo sapiens
cccgctgcccaaggctgggcgcgagtcccagggctttttcagagatccctagacctctgcgtggcggcccctccctgagagcacccggttaccgtgactgaacggcgtcctgcggctccaggcctcagccacctgctttttcaaggtttcttccgtaacagcgtccgaaaactccgccatcacctccttctttcccttttttcccacccgggctgggccgggctccgctggccgcttcccattcatctcttcccaaggcacagaaccacgccacgcagatcaagacgctaccttcctgagggtactgcaactcccggcatgtcccctttatcgtgtttcccggccctacccaatgggaagcaccaaagtaagagaaggcggaacctatacccggtttaccaatgggagctccagctattgcagccatcccaccagcaattggcccactggagctcggtctggcaggccaccgcccctctacttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaagtgcggcgcggccttggcgggcatttctctcgtgaaagctcctatagactctccgacgcgcccccggcttttcggcgcgcttcacgcctctgcacctccccgcctccaactcccgctggcggatgcgcgccttcctccctctctcaggcccctttctcatcctccagcctccagggttagagtccttttctgaaaggaaggcttgttcccatcctatgtattcggtcataatggggaaaaacggagtttgcttttaactcatcctttccccacctctccagaggtaaccgacttcaaaatgtgtgtttttttaatccttccagtgaattgtttatgctttcgcatcacgtacatggtattgctttgtgagtgttgatgtgatacgaatggtataacctagtatcatttttgcagattt

SEQ ID NO: 10130 - DNA, 1719 bp, Homo sapiens
tacatggtagcttgcctgacagtgttcttaaaactggttgtcttttactaggactcataatgattgtcctcaaccgagaccttgagcttgcagctaagtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccataccttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctcacgtgttgcttctgttttcctaaatactgtagggtcaactatataactaattgctttttattttaagagacggaatgctaaaaccacatcagaatgccaagaggctgtgcatcttgttaatttttttcttgaactgttccagggagttacatcataattacctgtgtgtgggtatgcatgggtggatgaaagatgctgttctcattccatcccaatagagtcttctgtttcctttctcttttttacatttatttttagcttttgcagtagtgtttagtgtgggttttactaattaatagaaaaagcactgggcctttaaacttcttaactactcttctctttcatctcctaaaacttttgagtattcattcttttctgaagtttgcatttaaatgaaaatgactttcgctttggcttttaggtttagtttcaaaaaggtttaattctgcaccctagccagttaagaaatgttttagcaggtatgcccttgatatggatatttatatattttacac

SEQ ID NO: 10131 - DNA, 1696 bp, Homo sapiens
tgttcccagcctacaaatctgtacagcatggtactatactgaatactgtaggaaactgtaacataatgctaagtatttgtgtaattatacatatctaaacacaaaggtacagtaaaaatacagtattataatcttatggtgacctaaacttcattatctggtacatggctgtaaataaccacaaggccctaggacagcccttgtcaaatagtgttccaagtgagataataaagccccactgccctaagacctccctccactgtatgtactgaatgtgaaactagtcacccaaacctttttccttaggcttagtcctttagtgaactcaggtagaaaagtttgtcctaggggatgacagagccacatgattaaaggaacctgggtccctgcataactatggagaaatccttacataataaatgaaaaatgagtcattatgattttgaggtctatttgttacagcagctaacattagcccaacaaagtaatcactctaaattgactcttccttaatgtaaatttgttgtttgcacccatctttcagtgattaaaaagcacacaaatccaaatatccacatttttttttttttttgagacagagttttgctcttgtcacccaggctggagtgcagtggtgcaatcttgctcactgcaacctccacctcctgggttcaagcaattctcctgcctcagcctcctgcatagctgggattgtaggtgtccaccaccaaacctggctaattttttgtatttttagtagagaccaggtttcatcatgttggccaggctggtctcaaactcctgacctcaggggatccacccgccttggcctcccaaagtgctaggattataggtgtgagccactgagctcagcccaaatattttttttttttttttttttagacgggagtcttgctgtcgcccagactggagtgcagtggtgcaatctaggctcattgcaacctctgccacccgggttcaagcaattctcctgcctcagcctcccaagtagcttggactacagatgagtgccaccatgcccagctaattttttgtgtttttagtagagacggggtttcaccgtgttagccaggatggtctcgatctcctgaccttatgatccgcccgccctggcctcccaaagtgctagattacaggcataagccctgtgcccagcccacatttttgtttttctctactacaaaatacaaatgggcaattctgatttggtggtgattttataatcaatcaacacaaagtttaacatctttacattttaatgaaaaagtagataatctatttgaaaagtacaaactcaattgcaatttcaagaaaaaaatatgtatttatataccataaataagcaaaattggactctgaagccctaatacttcaaaagcattcatcctattccataaaaacctagtattattcagcaacagtactactactgatttaaaaatagaaagcaagtctatcttcacatgtagttctttgtctttaatttgtacaactcaccaaggttattttcattcttagcacccggggttcaccagggtgtgatccaaagcaaaccagcataggtttttaacagaaaatctttgccaggaacttcatgacctgtattttcctcacctaggaagaagctgtccccactcgcatgattttgaacagtgtgttgatgttattgcttcga

SEQ ID NO: 10132 - DNA, 1137 bp, Homo sapiens
gagttaatggcttgctcaagttcccaggaatcggttgtggactgaggaactcggccccgggctcttagtacgccgtcccttgttcaggtatccagggacggttctcacctctgtcttttctccttgcaggtgactcctgcacctgcgccggctcctgcaaatgcaaagagtgcaaatgcacctcctgcaagaaaagtaagtgggatcctctctttcctctaccccttccctgtcctccagcctgtcccctctccaccatcctcaggggaattaaagcagtctggggatgccccattgcgcggaaattgttgcctcctcagtgatccttatcagggagagcaggaatccttattcccggtgtcgctagtactcatctctgccgcctcctgtctgcccccaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgattctgtctctggtttcctttatatgccttaaaaataacggactggggtgagggattgaactgggagggcagagacctgggctgtggatggaaatgtgagccgttaagaaagagtgcattctggcaagccaggctactgcactgagcttcagcttctgtaaaactgaatggcgctgtgccagatcatatgggagcaggagggacacatacatgatcactttcagtttcacgtcaaatgtggcacagaaacttctccattcctcacttttactttcaatttccctgcccaacttcagttcttcgtgggattttagacttgaaagtgactacagagggtgaaatccaactccccagtggctggaatctgacatccggtttcccaaactccctgtggggaatgaccagttttgttttgttttgttttgttctccattagtcacagacctaaactctggtaaaataaggagttaataagaaaatgaaagtttaaaagacacaaaata

SEQ ID NO: 10133 - DNA, 4086 bp, Homo sapiens
acatcctctcaggcgaggagaatcgacgggagagagaggccgacccgtgttccccgtgttgctgtgtacggaggagcgggtccgagggaccgcggtgtggacagggacaggcaaggcgggagatgaggagaaacgaaagccacatcggtggcgggtgctctgcacacaactcgctggctaccgcacgctccccgcttcccactcagccgatccggggacaggagcaggagggctgcaccgggactccgggacaggcccagctgaaaacggcgaagcgagggatggggtggagacgcccgcgacgccaaggctggggtcccggaaagcgcggggaggagggtggaaggcaaaggcaacttcagggaaactgggaaaggcggccaggacctcggggacaccgcataccgccgggcgcacagcccctcacgcgcgaaggggcgccagaagggcggtcccgcggcgcgccgggagtggagctcaggggttggtgcccccggcccttctgctgcgcacaggccagcccaggaccgctgggggctcgaacccagcggggcgggtgcaagcgcggggcaaggcctctgcgcccggcccccttccttgagtaggaaagcagccgcaggttgtggcgctccaccacgccgtccacgtgcgccttgcggtctctccatttatcgcttgagatctccagccttaccgcggctcgaaatggaccccaactactcctgcaccactggtaagagaagcccaactctgcgccctgggattcccatttcccagccccagtactgagggtctctgggtttgaggaggttgcattttaagttctgagcggaaggggactcctttacttccttggggtgctttcttcctgatcgcgctcctgagagcactgccctccctcctgggcctctaagtcagagttaaggatactgaggctcaaggcagtcctgctccacatcacccagttggtcagggtcctgctggctgggccccagtgttctcctccaggctctgagcaatcagggtggatgctgagctagaggcattgagtcttcagggttcaggacagaaggttctggctggcaatctcagaatacctgggttgtatgtgcacgtgggaccttcctgataaggtgaaacaggagggtgcttgcccttcccagtgtgagtggagaggacatggggcttctgttcctctgtcctgagtgggaaaggagctctgagggctggccctgcacagaggagggggcactggagactcattgacccactgctgtaccttcttcatctcactcactgccaactgcgttttcctcttccttgcaggtggctcctgcacgtgcgccggctcctgcaagtgcaaagagtgcaaatgcacctcctgcaagaagagtgagtgcggggccatctccaggaatctggggctgtggttaaggttgggagggaactcaaggctggccctgagtgcacccttctggtgaactgggctttctttgccctcgttgcccatttcattccttctcccagctttctgccctgagttcagatggggcagaacagcatttttctcttgggatgcaaaccccaactgtaccatctatggtttcagaacagagctatgccagacgaaaaaagcttcctctgggtctggcgtctgagctggagccacgcttgctattagggcagggaggtgcctggtgaagtctgctgccacctctcactctccccttcttccccaggctgctgcttctgctgccccatgggctgagccaagtgtgcccacggctgcatctgcaaagggacgtcggagaagtgcagctgctgtgcctgatgtgggaacagctcttctcccagatgttaatagaacaacctgcacaacctggattttttttttatacaatactgagccatttgctgcatttctttttatattaaatatgtgagtgacaataaaacaattttgacttgaatcttactctgttcttctttgtgtgccttggaaaaaatggactggggtggaggttaaaccgcaagcttagagaccaggctctggatggaaatgtgagtcactaataatgtgaacaccttcaggccagtcaggttacctcactgagttcacacttctgtgaaatggtactgcactttgccacaccatatgggtggggaccatacatgatcgcttccagtctcatgccaaacgtggcacagaaacttcattccttatttttattttctgattttcctccacaacttgagatccacattggattttaggcttaaaagtggctatagtgctggaacccaacttcttagtttcttgaatcctacatgtgtgctatgatttagatattttgtcactgccaaatctcatgttgaaatgtgtcctccactattgcaggtggggcctagagggagcttttggggtcatgaggacacatccctaaagaatgacttggtgccatcccatggtaaagagtgtgttcatcctctggtaggtcactccagtggtggctgtgaatgaaagtgattagaaagggactggtatagactcaatgttatgccttagtcaggtgtactttagggaaataactggatgtcttgctttttaattttatttttttagagaagttgacttgctatgtggactaggcaggactggaagtcctgggcttaagtgatgctcccgcctcagcctcctaagtagcttggactacagcttcccgccacctcccccatcttgctttttagtttaaagcagggtcagcacatcacatgaagtcatctcctttttggggatatcccacatgtccagaactgccagacggtagtggggtggccggctaggctgtggggagcacggagatttatttgcaaaggaggacctggacaaatgtgcccccacatcctctcaggcgaggagaatggacgagagtgagaggccgacccgtgttcccgtgttactgtgtacggagtagtgggtccgagggacctaggtgtggacagggacaggcaaggcgacagcgaggagaaacgaaaatcacatcggtggcggttgctctgcacacaactcgctcgctaccgcacgctccacgctctgcactacgccgatccggggacaggagcaggaggctgtggctgcactcagacttcgggacaggccgagctgaaaaccgtgagaggggtggggtggaggcgaccgaaacgccaaggctgggttcccggaacgcgcggggactagggtggaaggcaacttcggggaaactgggaaaggcgaccgggacctcggggacgccccgtaccccgggcgtaaactcactcccgcgttagcggccccaaagcggggagggggtggtcccgtggtccgcacccaggggagctcagtggactgtgcgccttgcctttctgctgcgcaaagcccagtccaggtcatcacctcgggcggggcggactcggctgggcggactcagcggggcgggcgcaggcgcagggcgggtcctttgcgtccggccctctttcccctgaccataaaagcagccgctggctgctgggccctaccaagccttccacgtgcgccttatagcctctcaacttcttgcttgggatctccaacctcaccgcggctcgaaatggaccccaactgctcctgcgccactggtaagggatgctaggtttctggtccttaggatacctatttccccgccacaggatagatgtccctaggagtagaggtgttttttgagttctagctaagtggagtcatttatttcattgatctagtgcttttccactcagcgccttcatcatccctagaacattcctattctaatgcctcccatttcagaggcgagaggactcaggctcataattctcctgctccatgtcacccaggtagtcggggactgctaggctgagccccagtactctgcgcagttcctggggtggatgggagacaggagttattggtttttcgggattaaggacataaagcccatcctagcctctacagatagaagtaagattaggcttcatggtgccctgagttggacaggagctatctatcaggcctggcaatgcactcagctggca

SEQ ID NO: 10134 - DNA, 4086 bp, Homo sapiens; identical to SEQ ID NO: 10133

SEQ ID NO: 10135 - DNA, 4783 bp, Homo sapiens
ctgggaatcagggtgctgggcagagtcagaggagggaaccgagagctcagcaggcaggagcaggacagtgacaagcttcccacatcccctttctggtaagtgattctggatcacagctggaaaaacacaagatagttgattcccaactttcattcttaaaatggggaaactgagggcatgtgcgtgcaccaacctgccaagcacagacctgacacttcaggactttcctcacttaagtgtacggttttggggaactggctttcctttgtccctgtagccccagtcactgcctctccagtcttctgtcatctctcaggtataggttgtgctgggcagctttttcactggaagaccctcaccccaaagatccaccagttgagtcctaacagagcaatgccaccctgaactgagggtcctctggggctggaggcagggcttgagccaggcctctgtcagggcagagaggtctccggtcgagtctgctctgacctctcactctccccttcttcccagactgctgctcctgctaccctgtgggctgtgccaagtgtgcccaaggctgcatttgcaaaggggcatcagataagtgcagctgctgtgcctgatgctgggacagccctgctcacagatgtagaaagagtgacctatataaacttggaatttttttccatgcaaccatgacccatttactgtatttgtctctcttttatgaaatatgtgaatgataataaaagttgttgacttattctggctctggttttctttgtatgcatggaaatagtggaccccatactcaagagagctggtatgtgtgactgcattgagagtccagagacctgggtgctgggaccatgccctatcatcttacaccatgagtgccttaaggaaaaccaggttccctgtctcagatcactttttcagctaaaaaagattcctttaagattataaaatggtatttttactgtacctttctatgtttagctacacaaatacttaccattgtgttaaaattgcataatagtgtataggtttgaagcctaagaacaataggctaaagcagacagccaagctgtgtagcagccagtatcagctaggtgtgtgtgagtacattctacaatgtttgcacaatgacgaaattgcctaaagacatatttcttagaatgcatacctctcattaagtgacacatgactgtaatagggttggactcgtagaggccaatgatttaatggatgtaaagaactcagaatggtgccttgtacatgaccagtggtctataatattaactactattttgttattattattcacggctgctatggcctgaatgcttgtgtccctccaatattcatttgttgaaatctaactttcactctgttgcttttaagaggtggtgcatttgggaagtgactatggcatgcaggcaaagcgctcatgaatgggattagtgccttaataagagaggcctgagggagcttgtttaactctttccaccatgtgaggaccagcaagaaagagacatccatgaggaatggggccctcacaagactccaaatatgctggtgccttgaccttggacttccatgactccagaactgagagaaatatatttttgctgttttaagttacccagtttaaggtatctggtggtagcagcccaaatggactcagacgatagcatagttgacatttttactccagacaaaagagccaggcctggtgtccctccctgtgtgtcctctgtctttctcatcagccacataagcattgacctgtggtcctgacagggtcctgcactctgccacaaaataaggattcacaccagaaatataaagccatgagcaagacagtccctgtccccatcacagaaatggaaagacgcctgccagttctgctaccacctgcaccaatatgtgactcaacatttttcttttaaatgattcctatttccttagatatatttatatgaaaagcaaactcattagcgctactgaaaaaagaatcaatttaacttccagacatagaaggttgccatgaaattctccttattcatacccctctgcatccctgttttgcttccaggactgaccttgatgcttggttttgtttaaagatttcaaacagtaaagagacgaatatacctaggtcagacggaagcttcatcagtgccctctctcccttgggaagctgacaggactcagacccagcagtatcatttcctagccctctgaccacgggctagtggcttgaactccttgtactgtcattgtccagattaggaatatgggttcataaatagaatgtgtgtcccttttgggttgctgtgagggttcaaagattgaaagtgattaaacagggcctaacatggattaatgttatgtacaataataggaatatggaaggaaattgctttctaatttcatccaggatctgcatgtcaccttcaatgatccctcttctggggacatcccacattttccgaatggccatcctgtcgtagggcggccagctaggctgtggggagaccctggagagatttatgcaaaggaggacctggacaaatatccccattcagcttctcaagagtggagaatggaagggagggagacagagccctgtgtctctgtcctgttgctgtgcacaggagaaatgtgactgagggaccgaggtggggacatactcaggcaaggtgggaaatccaaaggtcacagcctccaccagtcctttgcacacaactctctccctgtgctcccgctgctgctgatcctgaaagttgaacacggggctggggttgcacacggtatccagggaaggtaacgatgataacagtcctgagtcaggccaggtcactgctcatggcccaggcatggaccacgggcagtgcagactcagcaggggtgagtgcaagggccagggcggggcctctgcaccccaccacctcccccgactataaagggagcagccagctcctgggctccatcacaccttcctcctgccctgacttctcatatcttgcctaggaactccaggcttgtcttggctccaaatggatcccaactgctcctgcaccacaggtaagggacgcctggctctgggccttgagatgcccattcccggccactgtacacagtgtccctgggttagagaaggttgcattatgagatgtgagttgaagggaactcgtttacttttgccagtgctttcctcttgcccaagctcctgtgagcatctccctcctctgtgcttgtaagtcagagttggggattctgaggatcgaggctgtcctgctccatgtcacccacctagtcagggggctgctggctgcgccccagtgctctgctctaactctgagcagccgggaagggtgagaggtgggggacatagcctcttcagagttcaacacagaaggttttggcctccagccccagtcttcctggactgtgtgtggagctgggaccttcctgatggggtatataaagaagggtgcttgcccttcccagcctgagtggagaggacatggggcttctgttcctccgctctgagtgggaaaggagctctgatggctggccctgcacagaggatggcgcactggacactcatggactcactgctgtaccttctgcatcttactcactgcccactgcctttttcgcttccttgcaggtggctcctgtgcctgcgccggctcctgcaagtgcaaagagtgcaaatgtacctcctgcaagaagtgtgagtgtgggatcatctccaggaatctggggctgtggctaagcttggaagggaacacaaggctggccctgagtgcatgcttttgggaactggtcttcctttgcccctgttggctgtgtcattccctctccaggctttctgctctgagctcagatgggtcagggcagactttttctattgggacacaaacctcaaatgtaccatcagaacacagctgtgccagcctaaaaatgcatcctctgggtgtgggggctgaacttcagccaggcttgctgttgggacagagaggttcctggtcaagtcagctgtgacctctcactctccccttcttccccaggctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttgattctgactctccttttcctttctgtggcttggaaataacagttggagtgggggattgaactgggaatttaaagacctggttctggatggaaatgtgagcccctatagtctgaataccttcaggcaagcccggttacctccctgagctccatcttctgtaaaatggaactgcactgtgtgggatcacatgacggggttggggggacatgcatgatcgcctcgggtcatgtcaaatgtgcaaatgtggcagagaaacttctccatttctcatttttattttctgatttccctgctcagcttcagtccctcatcagattttaggcttgaaagtgatgacggggtggaatccaactcctcagttgcttgagctctacacggggcttctcgaactccacagtgaagaaacattttctaattccaatccatcccaggcctaaacctttgtaaataaaataatattaattacagatataatgaaatcaaacacaa

SEQ ID NO: 10136 - DNA, 1139 bp, Homo sapiens
tttacctgaagaacagagattctttccaggagaaatggatattccacatgtgccacacctgctattctaacacttgtggagggaggcagtgcccaacattccccactccatccatgaaccctataccagggccattcagtccttttgaaagaattgagtcctttgccttggttattaggaagcagcagccagagcccttccattctcctgtcttcccctgggtgcttcctcactaggacagaggcacagacctgcctgtggttcttctccccctggaccccgctgctcccgttcctcaggtgtttggaaggtggggtggcagttagctttggtgtgttacccacaaccccaacgcaactggggagctggccagtgtggatggctcagccactccgaggaaggaaaggttggccgaagcttctgccggccattgcctgcttcaggaggtttaaaaagaagagaaaatagatactttgccatttactttgctttttatcatttcagatttatatctataatgagaaaattgtaaatggacacctgcagcctaacctggtggacctttgtgcttccgtcgcagagctcgatgataaggtagcacctagagctaactcaagtagaaaccggggtccagtgttccgatgggcctagcaacttgccgatttggttgaaatgtgctgcggagacacgccattctgtggaatgaaatgttaactgttcttcagttttattttaaataactttgggtggttttcttgatgatgaatttttaaaaatgcatcttcaaaaggccctgccagtatcaattgatagtcacaagagttctcttcaagccgtatttgctttgaagtcccatcaggcttttactccccactcaccagtttccctccttacacaatctagtaggctccttaatgagagcagaattgttaaggtgatggctttttacacctgtgagccctcgaacttgactcggtggggcctttgtgagcattctttatataccactggttctgttcctctgacacacacatatactgcctttatttgttctcctgcctcaccctttattcctggccagttttctcccataaggggcaaaaaaaaaaaaaaaaaagggggatggatgactacttggt

SEQ ID NO: 10137 - DNA, 1270 bp, Homo sapiens
gttaatgtcttaaggttcccccagaaggagatttgagtgcaagttgtttatttaggaggtgatctcacatgaataagggagtgtggaggccagggaggggctaagacagttaagggaaggattcactcctgtccatcactgcttgagtgctgctgggttgtgcaatggagttctaattccctggcatttctcacctgcccatgaaggcctcagcaaatagaaaaccggcaggccaatagatacaggtgcaggtagttgcaagtcaggttaaagcgatggtaccgaggggaggggatggggcagagacagtgtctcttaccccggatgaaggaaggcttccctgcttttatgtgtttgggacctgggacgctttcagatgcccttgaggatttttattgagtatgtatctatctgtctgttcccttatgtctgtagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaaggtaggcactgtttcccctgcccacatagggctttaccccttttctgtgctcaagtccccgcaaagattttacctgcttaatgtatgatgccaatacagtgatcaggaccagtgggttcctcgtctcctgtccccattttttgttgtgtaattcccagctcataaccatagccttaaacacagcttctagctgacatcattgagcatggctgctgaacagctacaactctgtgcatgtggctcagggtgtcatttgtaccaatgcatgtgtttctcttggggatttagttgaaccaagtgtgttttgacgacgatggcaccagctccccacaagacaggctcactctctcacagttccagaagcagttgttggaagactatggtaagattctggacataaccacctttcccttctcttgtccacttaaggtgactacttcagttttcctctgggaaaatttttcatctctgaacttttgtctttcttccaaaactcctatagattgtcaaggcaaaacacaacaaaactaccattccaaattcaaataaagggcatgtggccttaagaaatacataaaacttatatggtcatacacaataatctgttttctctaattctttgaactgttctagtagacatatgctcagggagagaaaaagaagacttagc

SEQ ID NO: 10138 - DNA, 1186 bp, Homo sapiens
caacatcaacacagttgtgctgtggaagcctgagaaacagccctatccagcctagggcatcattccctggggtcctggctgcctgctgctgtgcctatggggcagggggcagggatttaccctgccctttcctaacattatttggtgttcatcatagccctaattgttttctcattgtttcattacctcattgtttcattacctgtaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcagagactcctgtcatcctagcagtttactctgcgtttgttgtatctagacagtcaacaactgagttgtcggtgtttaacctgaatgcttgtttttcagaagaggactgtttgtgccggtaagaatgatcaggtaaggccatgaaagtttttgttggcgtttttgtttttgagatggggtcttgctttgttccttgggccagagtacattggctactcaca

SEQ ID NO: 10139 - DNA, 1261 bp, Homo sapiens
cccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtagtgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggaggga

SEQ ID NO: 10140 - DNA, 1187 bp, Homo sapiens
taataagaattatcccaggtcctcttgccaactgtgtagataacatcgatgttaataaaaattctctgatatgtcaggaaaaatgtattcatgtgctttcatcaatggcctataaattaaactatttgagagttttttttttttttgagacagaatcttgccctgtcgctcaagctggggtgcagcggtgtgatcttggctcactgcaacctccgcctcccaggttcaagcgattctcctgcctcagcctcctgagtagctgggattacaggtgcgtgccaccgtgcctggctaatttttgtatttttagtagagacggggtttcaccatgtcagtcaggatggtcttgaactcctgacctcgtgatccatgcgcctcggcctcccaaagtgccaggattacaggcatgagccaccgcacccggccgagaattttttcaattcaaagttggaagataatttttagtttgttgctgggtgagatggagctaaatctccttgtttctctttagaattttaattgcagttctcacttgaaatgattttttttgtttttgtttttgttttgtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaaggtatactgtgacagtcagtataatggtctttaatccacacagcaaccctgcagagtaggtattaattgtcctcacttggttttatttatttatttttttgagacggagtctcactctgttgcccaggctggagtgcagtggcgcgatcttggctcactgcaacctctgcctcccaggctcaggagattctcctgccttagccttccgagtagttgggattacaggcaccagccaccacgcctggctaatttttgtatttttggtagagatggagtttcatctgttggccaggctggttccaaactcctgagctcaagccatcctcctgcctcggcctcccaaagtgctgggattacaggtgtgagccaccatgcctggccaattgtccatactttagagttgaggaactgagactcaggggcgaagtcacctatgtaaggtcctgcacagctgggagcagagccagcatactcac

SEQ ID NO: 10141 - DNA, 1531 bp, Homo sapiens
tcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaatgagttgtattctttctttaatgtagccactgccataaggttattaattattgctttggtcttttttttttttttttaaatgccacctctcctgggcttgctttcccttgctttgtctataaatgggaggtccaccacagcccaggcatgctgggagcacttgc

SEQ ID NO: 10142 - DNA, 1555 bp, Homo sapiens
ccactgcactccagcctgggtgacagagggagactccatctcaaaaacaaaaaaaaaagaactatggcctcctagggaacttttcatgactatagtttttcacgaaaccagaaatcttgaaaactcttagtattttggtctcaattggacctgcaaacatagccatttccttcaggccactgtggccacattatgaaattaggcatttctttcttctggctggtatgcctgggataagctgacccttggcttccccattctctctctccagtgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaacttgatttgattctccaagtttgctttgcttatcctagtccctgctggtggattttagttgtttgtttggctaattgaagtttggctccaaagccccttttatacacaggtctaagatgacccctagtgactcatgcccttgtgtaataacccccttgagtttcagcaggacctgtg

SEQ ID NO: 10143 - DNA, 1529 bp, Homo sapiens
tctaataataaggctgacaatggttcagccctagtgtcttgattccaaaaacctcacttctttattttttcctgtcatcaggagatatcactgactcctgggaccctggtatatcaagtctctgtatcatagccacacctgccaccttgcaaacctggatcttggccaggtgcagtggctcatgcatatcatctcagcgatttgggaagatcgcttgagcccaggagtttgaggacagtctggccaacatagcaaaaccctgtctctatgcaaaaaagaaaaaaaaaaagagaaaaagaaaagctaggtcttttctattagagtctagaggcaaggtaagccctcactattctctttatttccattcccgtgtcagctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgttcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtttcccattgtgtagttagtttccttatcaatcatgataggtatccaggaccccagagggagacaggttaagttatggcagccaggagacctgtgttctggcgctgccactgcctaatacatagtggtaattatagtacctctgcgtctctgggctcaagtcttcccatcagtaaaatacgggtaacagaagccttcccacagaccatcagctcccttggctgctcttgtctgacgattttagtggtacattctttagccccagtaattttctcagcctctacactggctgggttccctttgcacgtctggttagctctgttttctgctttgctctcttctgcctgtcagctgaatattaatgggggaaagtcagcaactaattgaatttcagatctcttgtgggtcttccactggatcttttttgcacctctcaattccttgtatctcttgacatcctgtgaagttttcgca

SEQ ID NO: 10144 - DNA, 1167 bp, Homo sapiens
ttacgtacatctccctcgtgggctgcagcatctccatcgtggcctcgctgatcacagtcctgctgcacttccatttcaggtattccgctgccacagtgctgggcctgccctgcactgtggcacatcacgcttccttgtgtcccatttagtccactagaactgggtgtgcttctccagagggtggggaccaggaggcgggagaccagccttgtggtgcgactgctgtgggatccctgccccttcttcgcctcagtttccctgtcggcatgcacctatgcacccagtgggtagtgctgcctgggtgatgtccctgggccatggaggaccattctctcacctgcaggaagcagagtgactccttaacacgcatccacatgaacctgcatgcctccgtgctgctcctgaacatcgccttcctgctgagccccgcattcgcaatgtctcctgtgcccgggtcagcatgcacggctctggccgctgccctgcactacgcgctgctcagctgcctcacctggatggccatcgagggcttcaacctctacctcctcctcgggcgtgtctacaacatctacatccgcagatatgtgttcaagcttggtgtgctaggctggggtaagcacatcatctctcctcgcctcctcagacttccaggtgggcagggtattgatcccctttagtcctttctttcccctcctcctcatcgtcatagtggccattacatgaccaccagctgtgaactctgtctacacccacctctactttctatgttactaattttatcacctcttccacctccatcatcatcatcgtcacctcctccaccaccattatcacctcctccaccttcattatcaccatcacctcctccacctcctccaccaccattatcacctcctccaccttcattatcaccatcacctcctccacctccatcaccaccatcatcatctcatccacctctgttatcgccatcacctcctccaccttcatcaccaccatcgtcacctcctccacgtacatcaccaccttcttcaccaccatgatcacctcctccacctccatcaccacctcctccaccatcatcaccatcatcatcacctcctccacctccaccacctcttccacctccttcaccaccaccatcatctccttcacctccaccaccac

SEQ ID NO: 10145 - DNA, 1158 bp, Homo sapiens
aagagaatagtaatgaataggatgggcctaggaagtttgtgacagtgagaggccacacggggacgcagcacagtgcccggctcataggaggtgctcgctgggtctcatgggtgcccgacagcacgtgcttggcaaacactatggagaggtggggcagacccgagtcacaatggctggggagggaggaggagggatggggtggggctcccccacctgctgaccccgtgccctcactgcccgcaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggct

SEQ ID NO: 10146 - DNA, 1196 bp, Homo sapiens
gcctgtgcagtaagccccctccagagcagcccctgcagccccctccctgtgcctcagctgccccgggggtagaaagggccgggcttgcctacctcctaggtgaggagtgagccccgccacaggaccgggacccagggctccagcccctgtttagcccagatcatgggagggcctggcccatccttgagtccaaaggggtagcagcagcagggtcttgtggggtactggcccaaggcaagcccaccagtgagacgcctgtcactttgatttcagcctgacggctggggctgcagagtctctaggtgagtgtggggcctgtggcccagggctgcccgcctgcctgcccgcagtgggttgcagggctgcgctgggacgttctgctgttcagagctgggtctagcccctgctgtcgcttgtctatgtgcttttgctgggttccctcctgctctcggtggcaactgctgtgggctgccggtgggcaagtggacaagaggctgatgatctcatgcccctgcagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaa

SEQ ID NO: 10147 - DNA, 1231 bp, Homo sapiens
cctgatctggtgggtgccttccctgcagggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgaggaccttgggttagggcgggccagtccctagcatgtaggggctacgctagcagtgagacccagtcaccccaggctgtgcaaatggacctccccgcccctagacctggccacacacaccctgtgtaactcccagtccctcctctccacctttgaccacagcacctctgccatgttgcctgccctcccaccccatccctcaggcctctccaggaagccttctgacggccccagctgtgagctccctctcgtgaccctgttgcccctccagctggcccgggtgggcagtgagctctcgtgtcccctaggtgtcccccgtggagaagaacactagcgagacgctctattccctcaagtttgctgagagggtgcgctctgtggagctggggcctgggctacgcagggcagagcttgggtcctggtcaagccaggagcatctagaggtacggggactgtcacaggcctggctcaggtggccctgggtcagagactttgggtcatggcaggagcagggagctgggcggggacgtcctgaagcagtgggggcagggaagctgccggagttgggtggagctacggctggaacccacagccagcagcctcttcagtacaggtatttcttcttggcctcggaggttcctgtggggtgacgagctggccgtgggggtggcacatagtagatgctcagtggtaactagttgacttctttacatgaattatctcatttaattcttgccataactgaggctggggcacaaacatcatgcccattttgcagatgaggaaactgggtgttaggaggcagggcaggggagtagagagaagcacagcagggtggggagccagggcagccgtggcccccgcccatccgcccttccctgctcacagtgggagccggcttgtcagacgccacagccctcggcacgggcccactcagcccccagctctgggaccagtagccgccctggatcc

SEQ ID NO: 10148 - DNA, 1187 bp, Homo sapiens
cggacggactcctgcgcagcctccttggcagtcctgggggtcccatctggagatgcggggctgtgtgcctggggtggcagcagctggcatgggagcagttgccctgaggttgatacgtgtgtggtgggactggacggttgcctgtggggtgtgcgcaccggaagcaagccagcctctgtgctggtgactctcagaccctgcagggatggcatgagcttcacctgagaacttgaagtacctaagaaccttctttgctggtgcagaagaccagctgctgagggaggccaggagaaggcactgccactgtcttgctgtgggacctggcacatcctcttccagatcctggacctcaacgtccccacccacccacaaagggagggactggacccgctgggccctgggatccttgccagctccgggagcacaccatcctctggctcgagggtccttccctggcacagtctccttcacgtgaggattctggttgtgtcttggcagcaggccctgcaggacaaggggtgcaagagccagagtcaggggacgaaagaagagaagctttggaagagacaggcgccggcccccaggcgggcccgggaggcccgggaagctggtggcaccatgaatgtagagaatacaggtaaagcaggcctgcccgccaaaccggcactccccagtgaagccagcgcaggagggaggctcttgtgcagttggtgatatccccatgccctgtcctccccggctggaggtggcctagacagactccagctgcctgatccgcagctgcaatcccccagcctgcctctcccggattcagggacagtggtgtgtatagaaccttcatctcacccatgcctcccacagcatccaggccccacccagtgataagagtccttggccagcgtgggctggggttgaatttccctgctttttgttttttcccagtgcctgtctaaagcagggcgagggtggcagcctcacagacgccaccacctgcagagagagactcggccttctccctcctatccgtgggcccccagggtctggaggctcctaggacaggactttgattctcctggccagaggctgagacaaaggagccagtggctcagctcttccctggcagggcctgccatggtgcccagggctggctggttctggaagattctacaggccccccttgtagtctt

SEQ ID NO: 10149 - DNA, 1142 bp, Homo sapiens
ctcttcctctcctctctctcttcctcttctctctcttcccctcctgtctctcctcccctcctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttggatcttttttggactacttgtatttaa

SEQ ID NO: 10150 - DNA, 1101 bp, Homo sapiens
agtataagcccagtgcagtccttgttatgtaaatttgatattagtaataaaatttaatcaggtttttaaagaaacagcacctagaaaacctagtaatttcaaagtgtcagagttagcgtggtatccatttggggagtgattatttaatagtgggtggctgttctgttttagtatttctgatttttcaaaaggaagaacatttatatactctatggtctgagagcctgctgactgtgttatatgtcataagcagctggtgttgtcttggcaacaaacaagataaacttgctacttccgggccatctgcatgcagtgtatgacctgtgtctggtctgtttattttcctctaagtctcagccttgggaaagcaagctgtgggaattcaggtccttgtctggacaaggttgtgtgcttcttccaagacagagctagtgtgatgcttcttctctgtatttcacaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcaggtactgctcctttcccagatagagccctgggttggggatagggcacactgcgtctaatattggcttgtggcccacatagcagaacagtgtgggtttctggcttcagttgccacactgtccagggagctttggcctcacaaaggtccaggaaatattcagaagtcgggtcaggtatagaggtgaatacagcaagtaagacctccctcttgccagaatccatccctaagacaagccaaggagatgccggagatgacgcgtttccagtcctggaagagggcctctagaagattcaggaaaagggggagaacagtcacatttcgcctctcaaaagaagcattgccttgacagatccatgcaaattgtcgcatccgacgggtttacttctcagacagactctactcagaagatgagctgccggcagagttcaaactgtatctcccagttcagaacaa

SEQ ID NO: 10151 - DNA, 2176 bp, Homo sapiens
aaccatttttgtttccaaacctagctcccccgaaattttaagactatttacctagattcggagatggtcttggagagttccaaaaggggtgtgtgtgtgtctgtgtgtgtgtctgtgtgtgtgtctgtgtgtgtgtctgtgtgtgtgtctgtgtgtctaatatttagactaaaccatggtaaatgtacgcacccagtatccttttcagttagcatattctttcttaaactcatctcagtacttttcatttgtttgcttcattatcttaaacaggttaaaagtgcctatgataaggacttaattatttcctaaagaaaagcaaaaaatgtggggaacagggtagtgttatactatcatctcaggtactgcctatgttcaagaacatagacctggtatggtgagaacaaaaggttcctatgccaaatccagatggctatatcatttgttggctacaagtgagcctgactgcaaggtttgcttctgctgagaaatcccatggtgagagtagaactcatgaagtgctgagtcacatttgcacctctggtgtggtggcagttcactctcccctggatgctgtcagctggccttgctttcatcctatccctgtaggcagggtaggtggctgggtaggagaagctattgagtgtatgacgcagaccaagctttcctgggccttctcaccaactagagaagcgctgatgtcgttcattgaggcacttaaacaccagtcactcagccaggcctcctcccagacattctgtaacatgtcagcactcacaaggtttaaagcaaatgtgttcccttgcagagaggaaggtgctctcagactgatagattagaggagacagacaaactcgtaatccttggggacttgaagagagtggctaggggaagggctgttaaaagaaaagggaccaataagaaaatccatctaaaggtagctcttgaggaggaaattaacttcttgaggggataaattagagggtaccaagtttatgttctggaatgtaccctggggagggcgctgcccactggattggtcccagtggactgaaaggtggtgctctcgagtcaggcgcttagtcccagagagagctgggtgccgcggggctcgtggtctgtgcctactcagggaaatgacttaggttctcccaggtgctctgttgataaggatggaagcagaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtaacatcctgcctttagaaaaaaataaccccgaggtggagaccagggcaggggaggtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagtttttcacttgctggctcttcttgctgtaaatggtgactaagaggttgggacagaaatcttgacaactagtggaaaacttggataatcttcaaggaccatggagccttctgtttccttctgtttgcagaaaagcaacactgcctgggttgtgatcctttacaagtgactacttcagacacaattggccacctctttgtatcactggatgactgatgtatgatttatgtgctgctgcccttagagggaagaaaaatgccatgttaaatcctgttttcttaaataaaaatgttgacaataaccagccttcccaagtgggagacaaaccattgctatgaggaccttaacttgtatttcctgtctctttgggggagaggggaggg

SEQ ID NO: 10152 - DNA, 1303 bp, Homo sapiens
ttttatatggctggaattccgtgatttccgtctctcctgttgcccccctgaccctggcttgcccatcagtctgtctctctttccgttgaaagggtgggtttgccatgggcttctctcagcactcaccaccctgattgcctgactttcctcctgctttcttgcagaccctgtggtgaaggagcagtcccagccttgtgcagacaatgctgtgctttccagtggtctcacggcagcacgatgaagactggaaagcgacgggtaatgcggcattgatgcttgccaataaaaccaaccaaccaaacacaaaccttgaaggaaaactacagtgtgataaaaagaaattcttatcattccttctaaatgcacagaagagtaaagacctaaaagtctgtcaaaaagcaagaaagaaactccccagtgctagtctccagggagctgtcactgtggcagcatggggatgcacctagttcaggatctgaaggagctctgcctttggaatgcatgggagatagagactcggagttgttgtacatttacctttgtttaacagggcaccactgttgaattaacccattcagtcaacaagctctgaatgtctgacttcctatctattccattgtggtctgggtttcctttggtgaaattcaggctcaagtcttagcgaaatgtcagcagtctatactgacacaccagcctcatttacaaaaaggagatattaaaacagtgacagtattttttttttaagctctttacaaatccacgttttatgtattttttaatgacatgagctctccaggaaatgtacctcatccccgcagttttcctccaagtggattcatttgggagcaaactgcagtcactttcacaagagtcctctttgatgtcaggagggatcacgaaaccttgcaatgccatgaactggtccatggttatcatcaaaagttccatgctaagtgcataacttggagctcactataacctttgttgatttccctaaccataaaatcttgttgctatttttttgttgctttttcttttttttttttttttttttttttggcagccttgtaaggagaacttcaccatttcccagcacatccctatgtgtgcgcctattttaatgcacctctctgaaacagagacctttttgttcacaaccataactaaagctggaaagtcagtcttcaggcaaggcgagggaggaaaacatcccattagaattttttcaggaaagacttatggaaaaaaatatctctctcccacctccttttatccccatgagacacagtttcccactgtaatc

SEQ ID NO: 10153 - DNA, 1234 bp, Homo sapiens
ttgcctgtgaaatgttctttttttccagtctggaattggtttccggggagcagagggtatagatttttttgtaagctcttgccatctgcaaatgctatagcacctcctttttccttatttttcttttttgagaacagcctgtgtcgccactgttttaccacagtagcccatgaagttcttcagagctctgccatccactcagaactcacttctctagagtatactgtggtgttacagtggggttagttttcttgatgttcggtaagaatgtgaagacagacaacttagacttcacaatggtgtaattgtggttaataattgtaattggcaaaatcacagagcattaaataggaaagatctgagttggcttaaatgtttttctcccttggaattccttccatttttttttttcttctcttctgatgattaaaatataaaaccttcatctttagtcttcccatttatttcagatcaggtagtaaaaaagtcatgggattccttagtcacttaagtatcaaataagcttagagaatggcctgcacttaggatgacaagatgcagtgagactaaattaactttctgttttctggaatctgtttcagcaactctaccagatcctgacagactttgatatccggttttatatgtatgaactacttaaagtaagtggtgttcataaaccattaatttttttcaggcctgttcattaaaagataagtttttgagagaacaaagagaacttaagcagaatgtttcttgatacccagaggatttagtgaagtttttaaacttatattgaggcctccatcgaggaatcttcacatagaaactttccagtggaactgggaaaaaagtggccaagtcaaggggtaccagggacattataccttagaacctcccatagctcttgttggtccatatgttttctctttgctgctttattaatacctactgtgaatgtaacaaatcatcccaaacttaatgacttttaaaaaatgattattgtttcttataattgagttagccaggtgattctttaggtctcagttgatttgactggggcaggatggtccaggatgacctcattcacaatctaggaccacagctggggcagcagggatagctgaggtctcatcctccagcctgtgaagttcatgctgcttcccatggtggtcctcctggggttcctagcagcagagagagggaaacctcaatgtataggcacttttcaacc

SEQ ID NO: 10154 - DNA, 1332 bp, Homo sapiens
atccacctgtctttactaaaggtgaaaacttttgcatgtggttcaatagtcagggagaagttagaaaaaaagtaatggaagaataatcatgaatttgtatgcttctatacattaactagctctttctccctttttccagagttctcttggaacggttgattgtaaataggccacatccttggggtcttcttattaccttcattgagctgattaaaaacccagcgtttaagttctggaaccatgaatttgtacactgtgccccagaaatcgaaaagtgagttcaaagtaatttttaattgtctaggaatgagactggagactgaaaaccatctgtctctaggttgggtcagctgaatgagatgcaaggtattgttaggcctactctttaatcagagatttgtaactgtcttcatccttcaggttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccacccctaccctcacccccccaatcctctcctgaaacttaaaaacagtgggaatataggaaagggaaccaaatctcattaattaattgttctcccccattaccccactgaatgaatggccatacaggctaag

SEQ ID NO: 10155 - DNA, 2844 bp, Homo sapiens
acatttctctataggatattttggaaagttatatatttacagtctgtatatgccatgcaactacaactttctctccaaatctttaattggcacagtgcatattttgattttataaactttactttagagctgtgccttgagcttcggcttcctgagggaaatcacatttctcttattgatacaaccacctttggagcatctgtgtgtttgttaaataacctcacaaattcaagcaagtgaatcacaataaatgtttggcctttccatgaaggtgtaagaagggtttagaaatactggtgctagaattggtcctctgcaggagtaagcataaggagttctgttttgctcattttaaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtgagtgaagcctgccagttttcagagtagagttctctgtgctttttgctacaatctgatcacaaaaatgtaaaaatgcttcaagccacaatagtgaaggaatgttctgtcagtatatttattcacaggtctagctgattattttatctttaattggacattatctgctcagtgcaggaaatacaaaaaagcataaaggaaagaattatccagaatcgtgcagtatcagttttggtgtatgtgactgaagttttttagtgtgaaaataaacttaaagtccctttaaacatagcctcttgttacattgttttgttaggctgccttatataagcatttttattggtgcgtgtttggcaggcatcttgttaaatgttcatgtataaagattaatgaataggactctcctgttctgcaaaaagctcacagtataactcctgttgcaggttgcagcttttctgcttgagctacatttcatttggtcctctatatttatcttataaaatagagaccccagttaggtgctaactagttgtacagtcctgtccagttttgcatacatatattttagggggacactactctttaactttgctattgattcttgagagatgaattgatgttgcatatatgctgcatgcctatatgtgggatggatttaagacagcttaaattcaagatataacaaaattgaataccatcacgtccaagagctcggcaataaaaggacggcagcctttagagaaacgtgtcactgtgacagactcacaaacacgaataatgtcaagcagaggcaaacaaccaaacccaattaagataatacttattccagtgtagtttagactaatcaaaatgtgggctgggtacccttagggtgtcaagacctttttaggagggctgtgaggtcaaaacttttttttttttttttttttgcgatagagtcttgctctcacacccaggctagaaggcagtggcgcaatatcggctcaccataacttccgcctcaggggttcaagcgattctcctgcctcagcctcccgaggagctgggattacaggcacacgccaccatgcccagctaatttttatgtatttttagtagagatggggtttcaccatgttggccacgctggtcttgaacccctgacctcaagtgatccacttgcctcagcctcccaaagtgctgggattacaggcgtgagccaccgtgcccggcccaaaactgttttcatcataaaacaacatttacatttttgggtctattctgtcatgagtgtacagttgaatttctcagaggttacatgaaatatactgtaacaagttgaacacagaagcagaaatgagaatccagctgtcttttattaagcaagacttagagatctgcaaaatgtagaaagacttagtgatgagtgtcaccagaaaatagttcatgtttcttacattagcacatagtgggtctgtttttaaaaatgaatatttttaaaatctaatttctaatgtggaaaattctgaaataaaacgcacagaaatgagaactctttggggtcccaagaaccactgctttaaaccaaagattaatttgaaagcctctgtcagaaacccaaaccctagccagttagaactgtcttcccatgttggcctttcagactaagtcctaagtcaaggtttcttaatttctaggtcgctatctctttttgaatgcaattgcaaatcagctccggtacccaaatagccacactcactacttcagttgcaccatgctgtacctttttgcagaggccaatacggaagccatccaagaacagatcacaaggtaagcgagcagcttattttttaaatgcttcaaaaggatctcctccctttcatcttttttttttcctctttatgctttcagtgttcagtgaaaatccgtttggttggttttttttttgtttttttgagacggagtgttgctctgtcactcagtctgcagtacagtggcgccatcttggctcactgcaacctccgcctcccaggttcaagcgattctcgtgccttagcctctcaagtagctgggattacaggcgcctgccaccacgcccagctaatttttgtattttagtagagacggggtttcaccatgttggccaggctgatcttgaactcctgacctcaagtgatccacccgcctcagcctcccaaagtgctgggattacaggcgtgagccactgcacccggccttcagtgaaaatcttttacatgtccaataatgtgttaaatgtgggatacaattgtgagcaaaatggatggttcctgccctcttaatactcat

SEQ ID NO: 10156 - DNA, 2720 bp, Homo sapiens
ctttttttttttttgatggagttttgctcttgttgtccaggctggagtgcagtgccacgacctcggctcactgcaacctctgcctcccaggttgaagcaattctcgtgcctcagcctccagagtagctgggattataggtgcccgccacctcgcctggctaattttttgtattcttagttgagacaggatttcaatatgttggccaggctggtctcgaactcctgacttcaagtgatccactggccttggcctcccagagtgctgggattacaggcgtcagccaccgtgcctggcctttaatgccgatcttttgtaaaagtacttaacattagtattctctacttatattagcatgaagaagataagtcagtgtagctgcttgggcgacttgtagtggctgaaaaacagctgagtataattatgactcatgtacatttctttctttcaggggtggcctatgtatgcacagctactgattgatttattcaaatatttagcgcctttccttagaaatgtggaactcaccaaacctatgcaaatcctctacaaggtaattaacttggatttattataaattaaaataactgagatcttaagaaaatacactttaggaatctgaggccttattttgtttttattaagcctttgaggcatgatatacattcagaaaagtgtaaaaatcaagtgtacttgcataactagcacccaaattgtacagtgtttgtatatgttcaactgtagaagatactacagttttacaaagcgtttgtaccagtttatacttgtaaacagcttggaggagttactggttttcccccatcttcatcttgccatacctggtattatctgtttttcattttaaccattttggcagttgtactgtgagatctcattgtggatggaattttgtttgttggtgatttatctttttttttttttttttttttttttttttgagacagagtctcactctgaaacccaggctggagtgcagtggcgcgatctcagcttactgcaacctccacctcccaggttcaagtgattcttgtgcctcagtctccctagtagcagagactacaggcatgtgccaccatgcctggctaattttttgtatttttagtatacatgggggatctcattacattggctacgctcgtctcaaactcctgaccttaagtgatcagtctgcctcagcctcctgaagtgctgagattacaggcgtgagccactgcacccaccctccttgatgacttcttaatgaggttttcatgtgtagatcagccatggatatcacctttttgtgatgctcctcttccagtcttttggctcttgtttgtatttttatttattaaataattctttatatgttttaaatacaagccctttgttgttactatatattcaaacatctcccactctcacagcttgcccttttactcccttaaaggaagggggaggtgtcttttgaggatcagaagctttaaaatttattgtagtcaaaattgcagatttttaaacttatattaaaagttgctttttgtgacttgtgtaggaaatctttgcgtgtctcagtgtgctaaggtgttctatttccactgatctgaattgtcagatttatgagcataaagtcgtttaatgttctgaaactattttttatgactgtaggatctgtaatgtcattcctgacattaataatttttgtgttttctctgtcagccttggttagggtttatcaatttattttttctaataactaacttgggccctgattttctcccttttcagtactttaaaaaatttattatatgcttttactctactttctttggttttcattagttcttttttttttttagcttctgaagatagacgcttacatcattgtatttttattttttgtccagtctcctcttctagcatattcatttcagcctgtaaactcttgatgcctagtttttcatgatacctaaatggaaatatttgataaatcatctgtgataatgttaattaaagcctaaaactttttaagaaatgttactaaagtatacttcattcttttgaggggggtggggggcttaagttacaataggaaaatgttactccattttccttagtgtggaaatatttttcttgttttttaaaaatagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtaaggttccaactagttaaaggaaaacttatgtcttaatatttcagtcctttctctgataagtagactgttcagcactttcctacccaacataacacgcacactattagttaagggtactctttaaaggaaataatgttattaagcctgatagaaggtatgatattgttgctattgctgttgctggtgaatattggttcacagcatttttctagttgctagttttcatattaattttgatattaaatttagctctatttacagaaccacagcttaggtgttggggcagtcatttgctgggtgtgccccacatggcaaagaattgcagaacaaacagacctttgtaatctttttctttttttgaggcagagtcttactctgtgacccaggctggagtg

SEQ ID NO: 10157 - DNA, 1153 bp, Homo sapiens
gtaaaaatggactgtgattttggatttgggaaattagagatgtgttcttcaagcccctcactgttcagtgggcaagtcaagtggaatgggatctctgcagcctaacagctttcctggcccctgcctactaaatgccaagataggagtaaatcattcccacatgtcaacttcatgtcagaccagacaaattagattgttatattgtgttaacatggtgaaatgtgaggggccttgctgatttctagagctgaagaagaaccattgggcatttgtggagaatattcaggtgtggtccaaggatgttgaaatgcaaagaaacacacaaaacactgaaggcggagtcagaccaatttatgaccctatcggctgccagcatgtaattttgtattcaaattgtatatatgctttcctttaatgttgggtttaagaatgcaaagtttaaaaagcatgacatcgaagtggtgagtggattatctgaatgatttacaagctctgatttgtgttttacgtaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctggtgagtattgtgtttgcgattttgtgttaaggtttgctggattaatgtagtaaaattttgggagtagaactcttgagcattttgagcctacattcatgtgctgttcactgtatttaagttggactgtgcttctgactaaggtttttcttctttcagcaatacattccacatcttgaggcctaccaaagctcctggctttgtatatgcctggcttgaactgatttcccatcggatatttattgcaagaatgctggcacatacgccacagcagaaggtgtggctgcagtttatctcctgtagatgaagactataactacctgggcttatttattagcattgcctatagatttctattagtcatttagtagtaattgtacttcttccaaacttagttgggaatgctatttagtgttcactcaagtcaattacttgactgcctctgcctgaaagccattcctcagtgattaggtgttgctg

SEQ ID NO: 10158 - DNA, 1323 bp, Homo sapiens
acaaggtcagtagccatcttcgaaaagtagtgagtattggactgcgactgccttttgacatagatagtactgtttatgtccaggggtttcccttttttctagtaggtaggtcggacacttagacttcctacttctgagaggtgagaattgttaagtagttgttttccatctggtctctaccttctccccatgttggatatagaaaaccagtaccttgttttggggaataaattgtaggtcattgttttaaaaggttacagtgatttctcagaagtggtattcgtgtataagtattttaatgtcttaaatggaatactctgtatcctaggatttgaaaggaaagcttgggctatctgttctatttcattactggctgtttttaaatttggacactgatttggagttgaatctcaaggcattcttagtttggagcaaatttccattgagtaaaatgggcccttttacagtatggttaagcctatatgagtaaagatattgaactttttctaggtgcctaattgaatgtcgagatgaatataaatataatgtggaggctgtggagctgctaattcgcaatcatttggttaatatgcagcagtatgatcttcacctagcgcaggtatggaaggaatttacttgcacggacaaaaggactcagggaagtacgtttgctcttaagtgttttccctctcacattatgttttctgtgttgccagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaagggtgaggatgaaatgctttgagatccctgtgcatttagtagtcttctaatatctttaggaatgaatatgcagacttactaacattacttgttataactgctttaccaaccacatatgggtgggtagctttggtaagggctaatattgtcacttgaagtatgaaagcctaattgactgccaagtcttcttggcacagagcagtacatacggtaccagacttagtgtcagagtcctatgtttaagccctggtcatgccacttaaaagctttctgattttaggcaaattgacttatcctccttaaacctattctttatagaaaatggaaataatttctcaaagaactattggaaatcaagagaagtaacgtaaagaaagcatggtacatagtaggcaaacagtgaatatttgtcgactctgaacatcagtttcatttaaat

SEQ ID NO: 10159 - DNA, 1155 bp, Homo sapiens
tgaattaattttaatagtttttgtaagaagtcttttttctataaactttattctttttacattttcccaagctagtggagaagttgctttcttttaagagcacttgagccacaaattttaaataagccagcagtgtgtctttaagtagttaatgcatattgtaatgaacagtttgtccattaaacttggatttaaaaaaaagacatatctattattgtgtatcacagggtatactgaatacatttccctgtatggagctcagtttctgttacccgaattttccattggttaactttaagtagaaactggtagtttttggttaatcttgatttacaaaatcatgaatgtgattgccagtaggaattggattgtcttatttaaacaaggtgttgactttgtcctccccaaccccccagattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtgtaagttggctatttccttggtataggtacaaaacgtattactgcttgtctgtaataatttttttctttgtctatatatggcactgggcgttaccacttattcttaataatcaccatatttgtttgatgtcttccatcattttagattgtaattctgtgaggcaaagcatcatgtctgtgtgtttttttttttttctgttatattctcaacacgatgtttgacagatagtagatacccaaatatttgttggtttaaataaattaagatttaaaaaggaaatgtgatatctgacaatctcatttctgttaaccaggaaggatgaaagctgtttgagaaggccgatacaaaatgacttaaagtgatgttgcatgtgcacacacttttcaaataattcacttactagttttgagtctcagatatcatggttaataattcaggtat

SEQ ID NO: 10160 - DNA, 1142 bp, Homo sapiens
aatggttggctttggtttttggttttttgttttgttttgtttttgaaatgtgatataggtgagaaggctaggggttttgttatggctacagaggtataagtgtttaactatgtttaactgtttttggttattttttaatccttgttttttgttttttatttgtttgactcccccctacccccttatgttgtattgaattgttttaaataatccaaattaaagggcacattttgggccagcttaacataatagcttttctttaggtttttaggccaccaaacccttggacaatggcaattatgaatgtattagctgagctacatcaggagcatgacttaaaggtaatttactgcttccttgtcctctggaacattctttgccttcacattattaaaacttacagtgaaggcagggtatttcgggggaagtactataataactgaaagtagagtatattatgagtaaaactaaagttttcttttaaaaattctaatccaactctggaactgtgcagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaagtaagtgtgctaattagtcaaggaaggcttctgttagctaggatactatcttaaatggtacttgtccatgtatatcgcaaactataatttcccacataatgtagtggtgaaactttgtatacgttttggtgagccttctaattatcaagcagaagtaatgactaggccttgtgttaccatcttagattccatcctgacagttcatgcatattattaactaaatgtgatttaatcagttgcctctcataccccagctaggccaggttatctcctttgttgtgtgaagtcccagaaataactgcatactatgatggcctgttaacccctcaaatctgggtatggccagacctgctagatctgccaagggaatgggactgttttatctacatgaagaagatgggagaagggtatgggagtgttgaatgattgggagttgtggttagaataaat

SEQ ID NO: 10161 - DNA, 1250 bp, Homo sapiens
cagttctcttacttcagcctcccgagtagctgggattatagttgtaccgccatgcccagctaatttttatatttttagtagagacggggtttaatcatattggccaggctggtcccgaactcctgaccttaggtgatccaccctcctcggcctcccagagttctgggattacaggcctgagccactgtgcccggccagtcctcttttttaaaaaacagaaaaatatagtcttgtagaaaaccattgtatgtatttgtattgctgctgggcatttgtgttgttaatcacttaaactattataaacaatgctgtcctgaatgttttcgtttgtatcttgtagtattcaagtgcaagatatctttagactctaaatctgtttgtggaatagctgttgtctaggagtctgtgcagtttaaggtcaaattctactgagctgaggcttattcaacaaaattcaagtattttaatttctaaaccatcatttatttcttaggaggaaaaacttctagaaccagcatacagctgtggtcattctttgctcaataacttgggtcattggcttaggaaccagcactatatttaaacctgtggatgggaatattccccattcttggttacgctgtagtgcaaaagaattcctggctctctgttgcacagctgacttgtgccattctgctgttgctgtatagagttaaggaacatggctctatttcgtttttattatctgatagcaagggtggttgggatacataaaagtttccacatactctgtagcaaagtttcaagaccatgttttttaaacagaagtttaaatatagccctaagtcaagaggtaccacagagtagatgggtatatacatgtgtgcatacctgcagccaaaacactctcctatgttagttctgcccccccttagaaaaacagtaaccggagaatcagttaaatggtttgggttttttagaaatttgaaaagaagtatataaacagtattatactatatctcagaaagttatcttggttggctgcagagatttgttaatgacctgggtatactgaagattgcaataggaggctaatttgattatattcctttgtatgcttgctgcctttaaggacttaagcatggctatcatcctcatttaaattaatttagcacttcaaaatagctttgtagttaggtctctgctttaaacctagctaaggttttcagagttgaaaatacttttctaggggaggatagctggcacataac

SEQ ID NO: 10162 - DNA, 1068 bp, Homo sapiens
gttccagcaaaagctcctcttgctggtcaagttagcactatggtaaccacctcaacaactaccactgttgctaaaacggttacggtcaccaggccaactggagtcagctttaagaaagatgtgccagtaagtagatctatcttttttctcttccaggatttatgattatattgtaataatcagtggtgaacatgtattagaattttatcataacacatgcctactaaaaaagatataaaagactgacatgtcttcctttgtatctcccatccttatatttcccagaggcaaacatattaatagttcactattcttgcctacatttctaatacacagtcataccatgtgtattttttaacactaaatctgtatacattattggatttttttcagggaagcatttcaacttatttgccttatgtactttattttttttttttagccttctattaatactacaaatatagatacgttgcttgtggccacagatcaaactgagagaattgtggagcccccagaaaatatccaggagaaaattgcttttattttcaataatctctcacagtcaaatatgacacaaaaggtgagcatgctgtcatagtttataaatgccttcttttttccttaatggactaaaggatgtatagttggcccttttacatactcactttaaaggtagaggtaataaactcaaagggaatatgtatatttaactagtgggtttggtagacattaaatagtaccagtttttaaggttttgttttgcagcaagttataagctttttgaaataagcttaatgttctcatggtgatagaaagtttcatttgtactagtcattagtcatacctcattttctcccagagactattcagagtatttattacaacctaataactgaggcaaactttgtgaaaagcataaagaatgcatgctacttgcccctcagattacatggtaagacagtatagttgacccttgagcaacatgggcgttagggttgccaatcctgtatgtagccaaatcctgttataactttttactcccccagaacttaactgttaacagcc

SEQ ID NO: 10163 - DNA, 1092 bp, Homo sapiens
ccttgaagttagagctataatagtctctggctggctgtgttttatggggaagtggaggaagggcttaaatgcccactgattccttttttgtttccaacagcggacttgtctcaggtgtggccagaggcaaaccagcactttagtaaagagatagatgatgaagcaaacagctatttccagcgaatatataatcatccaccacatccaaccatgtctgttgatgaggtgagtgtctaggatgatctacttatttattgtttaggccagtcttaaataaatgtccttttcaatgtttttagaaatccagctcaaagtgccctgatatagcggtttgtgttttgaaaccttaatatttgtctcaagctcttttggtaaatgttctacttaatagtcttttgttaagcatatttgagaaaggctcttagtaattgtttcctttatgtgtgcgttgtttttgtcttgcttttccaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacaggtaagtggataggtttcctgtgaaggatctcttccctgaccccgcagacagggtcttaactctcatccaggctggagtgcagtggcgcaatctcggctcactgcagccttgaccttgcgggctcaagtgattctcccacttcagcctcctgagtagctgggaccacaggtgcataccaccattcccagccttttgtaatttttgtacagacagggtttcaccatggtctcaaactcccaccttggcctctgaaagtgctgggattattggtgtgagccactgtgcctggcctgaagcttttttttttttttttttgagatggagtcttgctctg

SEQ ID NO: 10164 - DNA, 1159 bp, Homo sapiens
gttttatttgaacttgtttgtggaaagcgaaaaacagaatatgggacagagatagttacttaattgctccatttgcattatctaatgtgctttgtcctttaggccttgtcaatgctgctaaatggtactccatttgcctttgttattgaccttgctgcacttgcttcacgtcgtgaatacctcaaacttgataagtggctcacagataaaattcgagagcatggggtaagcaggatttgttcatttatttttgctcttaaattttggtggctaaaatggctatcaagtacaacttttaaaatttgtgcagcagtaataaactaaagaaaaatttgaaagaaacaacttttttaaatggcaatgaagatgttacttattttggattttagttatagtgcttagtagttatctttaatccaaaaacatttaagatcaattttaaatacactgagagacttttctattcttcaggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggtaagaagtacatacatgaatatgactttttttgaattggattatatgaataattgtagacttgcggaagaagaggttcagtgaaagtgacagcagtttaaaatggtccaatggttttaagtccaaagtcctatactatttatgatacatactagatccatttgagttaaggttttgtatctggtgtgaggtagaggtccaaattcatcttttgcatgtgaatatccagttgttccagcagcatttgttgagaccactactttgccttttgaattattctcaaaaaaagcaattgcccatagtgcatgggttagtttgtggtctctctcttttaagtggcaaggtcttgctgtcgactaggctggagtacagtggtgcaatcatagcttactgcaacctcaaactcctgtattaagtgatcctcccacctcaacctcccaagtacctgggaccacaggcacgtgccacccactctcagctggttaaattttcttcttcttcttcttcttttttttctttttgtagagatgaggttt

SEQ ID NO: 10165 - DNA, 1143 bp, Homo sapiens
tctttccatttttataaagcttaaataccattatcacattaacaaataacagttccttaatataggtagttatttacatttaagttccccaattggctcaaaaatgtcttttaaaaatttctatgattgagaatccagacgcagtccatagtttcttttattctgtaaatctgtctttgttctgtcttttaaatttattttttgccattgatttgatagagaaatacagcatttgttctctagtctaccccatgttattttcttacctgttttctcatggtgtttacttcattctctatccccatggttttcatgggctgaggatagagttagatcttcaggctcagttaaagtcaaccagtttcaacctcttggggcaaaaataattcttaaagagagtgctgtggacttcaaacttctaatattaaaacatgacaccaacttggttttgtgcttacaagctggtatcacttattttgaaaattaatctgtatacttggattttcattgataaagcatgtttcttcctttctcgttaggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcaggtaagatgtgaccgtgtgcttaccattttttcatctgaataattgatcttctttggagtgttgaggaagctcaaccagagaaatttttttttacatctctgaattattatgactttaaaagtcatactgtcataaaacttgttttatcttttagaatcatgtgagcaataaaatacaagatcccaaaagcaaggaggcaaaataatatttaataattttattttctttccttttttttttttttttgagatggtgtcttgctctgtcgcccaggctggagtgcaatggtgcagtctttctcactgcaacctccatctcctgggttcaagtgattctcctgcctcagcctcctgtggagctggg

SEQ ID NO: 10166 - DNA, 1104 bp, Homo sapiens
tcttaatgtttatagagtttaattttaatgtacattaacattctcactaatgggaaactttccacttgccagtgaaataaatagactgatattctaattgtttgtttttgatgctttctttgtatgggaagtgatagccctattgtgcaaatttaaagtaatatttagggtacgaattggtcagtagatggaatgccagtgtcaaatgttaaaggtacactgatgagcattttttgtgatataaaagtattcaaattttggaattgatgttaaagtcgtaacttcggctagtaggctggaaaaatgaaataagcttggctttgaatatgaacttgtgagagaattgggtttgaggggattttggatagagcaaaagaggattgtttgtttttaattagtatagcagttgtaacctttttcctctctcagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaaggttggtagtaaaatgtgttaagcttctgattattcttgtgccaaacatgatgtaattctttaaaaaaagtctctaaaattccttaaagttaatcatcttttcttctcaagaggcatgcttctaaattttaatcttccacgaactagtgtgtgtgacagctgtaaacatcctgggtgttaaatgtttatctccttcccctcaccagtttctcaaaattaggagccagaggtttccaggctagttgccacaataggcatattttggcttttggaaggaagagagagcattgaagcaagttagtgtttatggaacttgtatcgctttacacttaatgtgactaattttctcctctctgacccccacccctctaatttcttcattctgccttcttctgtggcttccttccttttctgcctcttgcgtatttttctcacttgcttagggcaccaaaggatattgtttcacactgttagtagcacttaagactgtgatacactggattatta

SEQ ID NO: 10167 - DNA, 1209 bp, Homo sapiens
cctgcctcagcctcctgggtagctgggattacaggcgtgcaccaccatgcctggctaatttttgtattttcagtagagacgggtttcaccatgttggccgggctggtctcgaactcctgcccttgtgatctgcctgcctcggcctcgcaaagtgctggggttacaggtgtgagccgtcacacccagccatgtattttctttttatacttgccctgcctaattgagaaacctggcatttcttatcaacagtggttgagctaccttactatctttttagagtcattagtaacattttaggtactaacacagagacgatggtagtttaaccctattctcttctaattattaatttgcaactagttgtgatcaattagttgtaaacaccactgcgcctggaccagcctcctttttccttttaatttaaaaatctggatttgtgtgtgtgtgtttttttaaacaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatgtaagtaaactagccagaaaacaagtgccattaaaggaatgagtagacagtggaaagaaaaccacacatttatgtgggcatgttgcatgaaaggtaactaacttttgccccttaattcaagtgatttctgtcatcatcatctgtaaaagagctcttagcccaatcttttttttttttttttttttgagacagagtcttactctgtcgtccaggctggagtgcagtggcatgatctcggctcactgcatcctctgcctcctggtttcaagcagttctcctgcctcagcctcccgagtagctgggattacaggcatgtgccaccatgcccggctgtatttttagtagagacggggtttcaccatgttggtcagtctggtctaaaactcccaacctcaagtgatccgccttggcctcgaaaagttctgggattacaggcgtgagccaccacgcccagcccaatcttttttttaaaa

SEQ ID NO: 10168 - DNA, 1091 bp, Homo sapiens
gtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcacttcactgtgtagctcagtctctcccacgcacataattggggacagtgggggctctcttaccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtg

SEQ ID NO: 10169 - DNA, 1707 bp, Homo sapiens
tttttttttttctttttttgagatggagtctcactgtgtcgcccaggctggagtgcattggcgcaatctcggctcactgcagcctctgcctcccaggttccaggttccaggttccagctattctcctgccttagcctcctgaatagctgggattacaagtgtgagccaccgccccagccttaaagtagctttttattcttattttattccaagctaacagcaaattctgggaacaggttttaagcgaggaaatagagcgttggtaagttggctactgtgccatgtcaggccggggagaatcccctgtaccgggaagaggtacccaagttctttcctctctgcaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgctgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaactactgtctactaagttatcttttttctttaatgggaggaaggggtaggagtgggtaaataaataaaggggtaggagtttggaatcgtgtagctgatcataagccagtagatgtatccactattccaaatattggctgaagattcgtcgttttcttcatgttgccattcagtttgtccagtccgaagatgctgagaatgt

SEQ ID NO: 10170 - DNA, 1219 bp, Homo sapiens
aaagtatagaaacattctcttcccaccatgtactataatatgacaccattttgttttaaggtgttcaataattgagtatagtatcttgtttacagaattcatctttcaaaaattttcagggagtctttaacgtaatctgggaacttttgtgcctagatgcatacaagacaagagacaatgagagggagtaaggtaatgaggtttactcagcttcacccttttgtgtgattacagtctttgtagaaattatgacattaatggcagtagtagaacagtggtgatgcctgatgctgatggtacaagtaatagtagtaggtcatatgagctactattaactccattctcagcgtgtgttaagatcttaacatctattaccttatttaatgcccatgtaatactttgtgctgggcactatttttataccaattaaaagaatctaaattgattccaaaagaaacttatttatctaatttaggcagtttgaccaagcttttcatataataaagagttctatagattgagaagctatctgcagtggagccgccaccaaaatgcagattttcgtgaaaacccttacggggaagaccatcaccctcgaggttgaaccctcggatacgatagaaaatgtaaaggccaagatccagggtaaggaaggaattcctcctgatcagcagagactgatctttgctggcaagcagctggaagatggacgtactttgtctgactacaatattcaaaaggagtctactcttcatcttgtgttgagacttctggtggtgctaagaaaaggaagaagaagtcttacaccactcccaagaagaataagcacaagagaaagaaggttaagctggctgtcctgaaatactataaggtggatgagaatggcaaaattagtcgccttcgtcgagagtgcccttctgatgaatgtggtgctggggtgtttatggcaagccactttgacagacattattgtggcaaatgttgtctgacttactgcttcaacaaaccagaagacaagtaactgtatgagttaataaaagacatgaactaaaaaaaaaaaaaaaaaagaagaagaagctatcaacctcataatttatatgaaaatcataggtttcctaattgtttttaattaatatttttgttattttgatatatagaagtgtttttttattttatttttcttatatatttatttatttattttttgagatggagtttc

SEQ ID NO: 10171 - DNA, 1207 bp, Homo sapiens
acatttaccccctcaccctcacacacaatcatgcacttacacacccacaaccacacacccactctcagaaccctcacccttttaccctactttattttcctttttcattgcagtgacatcagagtgtgtttacatttgtttttattttttctctttagtcggcctcattaagagaggaatcttgactgttttgtttagtagtaaacaaaacaagcaaacaaaacagtgtcctggcactaggacagtacctccatgtacagtattaggctcccaataaacattaaataaatatataggagggtcacactgcaggaaagccttctggagaaggtaacgcatgaccaacttgtgaagcaggcaagttgcgaaggaggtgaaataaggggagtgtcgaatatagagttagacagggagggatgttaaagtttgcatttttaaagtaactatggagctgttgaaggaaggcttttaaacagagaattttttttttctgggctcttcgcaataccataagtgagccttggagttaactcatggaccatcctgaagacatgaaaagaagcttcagctattttgctaaatgaagacatgcatggttctccatcattacctgatgggaaatgtaacagagcattgtttttctcccttacatgtggcaggtgaccccagcatttcacctggacccagatattgttttatcacccttcgtagaacacattcttttgacaagcaggccatgtgggatcctcctccccacatccactcacttctttcatgttttcagtcaatagaaagttcaatttcaaatcctttgagaaatttattgggattcaatgaaatctatagtcttacagctgccaaataaaagagaaaataaaaatagatgtcttcttcttctaggcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaaggtgagttagggtaaggaatcagacgtgtcagtggtatggcctgctctgccaaggcaacactgcaagaaacagggaggcgacggttaagaaatgagaatttgcgaaaccaggggctgacc

SEQ ID NO: 10172 - DNA, 1111 bp, Homo sapiens
cacaagtctgtctatgtatgtacagatgtgtatgaatggacagtatgactgtggtgctgctggtgctgctaatgcatgggggggttcatcatgaaagtgtctttttcagttagagcctgtgagcttactatcagagaaatggaacattttgcaaatgagataacaaggaaggctactaaatgtggccccaggaaggcactgtggttactcaaaggaattcaaaagcaagaatctacacaagactcttttgcctggccgggcacaagttcagcatcctcaataagcctgaggctcatataacattcaaagagctgcatgctccattatccacactgtacgattgtctggtgagctggaaaagaaaggtcaagcagaattattagcaggcagcctttactgcccttggtcatagacaatcatatagtaaagttacattgctactgtactggttttactggtttcactgccgtgaacttgaatgagatttggacaaaatccacataggacatttttttttaaaccttcacattaattggtaattatctacaagggactcccacttcccactcatcctttaatatagagggcatggtgagattaaatagattatgaatccaaaagaaagttgcaaagcaaaatactattgataaatatagacaaagtattagaactgatgaaatctctgtaaggggaaattaaaacataatgagctgaagtaacttgcccaagaccactttgcttggaaatgatagaggaaagattttcaaccctggcttccctatattgtgtgttgcacagagtattaaatgtgaaaagcaaataagataatgttgaatcttagctacttagtgcaaaccttccagtgatttccccaagtttaaacaaaacctgaagtcttttccattccccacaatggtctattttacgcaatttggcctccacttccttacagcccttctctctcaccagaaggctgtagtcactctcctcctcttgctcctctgcaagtattcaggatcttctcaccttagggtttttgccatttgctaatcacctggctggtagtttttatcctgcagatatgcacgtcattgtcttcctcagtcatttt

SEQ ID NO: 10173 - DNA, 1179 bp, Homo sapiens
gtccaatgtgggtgcgtacggtgtgggaggcctgctctgcttccaggcctggtgtctctgtggtgggtgggctgaagcccgttctcccaaatcaggaagtagagcttcttctttatcttttatggcaaaataacaaaaggaacaaaaattcttttgttcctctgtaaaatgggaataacaatttctagtcttgtaggaatagagataatatacatccagtcgctagtgcgtattgatgtctaataggtaatgacactggtaatatctgttgcctgtagacattgtgctaattaatgacttacatgcactattttatttagcttttgcaatgattaatctttacaatgaggtaattccaactcaccgtatttcacagataggaaacccatgccagaaacaagctaactaatttctgtagggacatttgagctattaaatggatctaaaatgcacatttaaccacagcactatgtcactatgttcagaagtacgtatatcttttcaacatgcttgaagacacattaagttgctaaaggataattttttaaaggatttattcaaagaattagccaccttctggcaatagccttctttataacatgcacataatgaaacatttgcataatgtttcttttgagaaacattcctcatattaagaaaggtttgtctttcaaacagtgagtagaactgttctaatcagggagtgagtctgcttaaaagagttttagagctcaaatgaattcaggaacattttacagatgagaaaatccagcaagtataggaatcaacctacttaagaaagataggtttgactctagaacgctaagatccttccactgtgcatacagagctttttatgccagaaaatggtatattccttctccaccaggaaaagtcaagtacttatcaaaagccagcctgaaccatttcccacctttgtctcttccattttccctgcccagtccttcagcctcttggtgtttagcctgtgtattataatgagaaacaacaaatatcaaataaatccatacagaggaaacagcagtgtcagcaactgagtgtcaagggtggggatggggtggaaaggcaaatcatcaaaatatataatccaggaaaattttcattattctcacctttgcgggctcattgatgtttagggataaaattcaggcttttttt

SEQ ID NO: 10174 - DNA, 1220 bp, Homo sapiens
ttggctgccatctcagacaggacgcaggcctgacaccctcagcttttagctttgtaaacttccctggcgctttgtagaatcttgtgtttcttctcttctcagcagatatcattcaagtcacaagaactgtctggttgagaaagtaatttaaaatatttgaccttttatgtttcttttatttagaaactgtgagagaaaataccgtcaatatctgttaggtctagaaaaattttcttccgaaagtgaatgttctgtttaattcttcttcatgcaagtgagtggcattttgtacactctttagcttgaagcggagtgggtcctattgtattttcccttcttttgtctggaatatattctttttccatttggatacagtttttcaacctttgggatttttttttcctttctagtttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtag

SEQ ID NO: 10175 - DNA, 1999 bp, Homo sapiens
tgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttgga

SEQ ID NO: 10176 - DNA, 1180 bp, Homo sapiens
caggaggaaaaaaacaaacagcctagctttaaaaaacagtgaaatagcagtgatttcatgtccctgtatgttctgattaagtcttatatgcagagaggacagagcataaagtctatagaattggcttgggcttgtgtagccccagtcatttgataaagatgttgttaaactgtgtcagcctgagccttcaaagggtaaatttaatcatgattctgagaataaagaacttcaggagcttcttaggtcttgccacaaaaatctgcaaatttgataattctcctgaattcacaatcatggacttgtagactatgaagagatattttatttgtttgtcttttatttaaattactaaggtctaggtttacaaagcatactacaggacccttttctatgcaatatcctaacttttttttttgtgattatgcttgtgagaaattttgtaatactacattctagttctgttttcgtttattttaaaactgaatccttaaacttgcaaacacgcctactgtaagcatgcttggaatgacttgttttggttttcagctgataggatctatgcctctggaccagctgaacttactggtgcagctttttgtgccctctactgagtcccattccagaaactttgagccatgctaggaggtaactagtctatgccttaactcctgacctttcctgcattagtaaaatttcctcctgggctgagcctttgggggttgattcacagcatttaagctttctgattatacctctcaaacattcttctgtcaattccacacaatccttctacctctgctatgctgaacccctcattcaccctgcacctgccaactgcaaaatattgtctgaaagaatctttcacatgttcctgcttcctatggctgcaggaaaggagaaaatgtgattgcatgtggtagttgtggtgatagacgtttagacaggacaggttaatttagcggattgtggacttaagattcaacctctatctggagaggtgaaaacacaaaggcttaaggacaacagtttctaaccaagtttctctgaatcctttcctgagaggtggtgggcaggagggaggagtgagacttatcagatgggacgcttgccccaagactgtgggataaaccaccattgctagtcctcaggaattagaccatatttagtataggagttgggg

SEQ ID NO: 10177 - DNA, 1146 bp, Homo sapiens
tttgtagagacagggttttgccatgttgcccaggctggtctcaaactcctagactcaagcaatctgcccacctcggcctcccaaggtgctgggatgataggcatgagccaccgcacccagcctatctcctagatcttgaatcaaaaataaaatgtaaatcacttccattctgctagcatgagggtttgttgctaaaattgaggattctatctgacgtttactttttgttgttttttgagacaaggtcttgctttgtcgcccatgctggagtgcagtggcatcattataactcactgtcaaactcctggactccaatgttccctccccttttagcctcccaagtagctgggtctacaggcatgaaccatcaggcccagataattaaaaaaactttttttggtgaaaacatgatcttgctatgttgctcaggctggttgtctggcattttctttgtcctttattctttatactagctaaaccctggagtatccttgaagcctttactggcatacagagtacctgaatcttactttggagcctagcatgggtcataaatatatctgattcattaacctgtgagacagctgagagaacacagactccttacctgtatctccaggcatatctggtttttctctgcctaatagattttcctgctttctagttagtaatattgagaaagaagaaaggcttatttatcatttgctttttttccactgtgaatcatctgttctttccatgaacattctggggagcacctcctgattaaactcctgtctccctgaccactatcctgctgtcattggacttcttgaagcacatgggctactgccccaggacactgggatttgagaggagtttagtggtaattgtcaggtctttcaaagcatttattattccttttatacggagatttcagtattgagacttaaaatgaactgaaaaatgagattgaacatttaatattttggatgtaacttttgaagaaagtatgctttggtgcttaaaattgtatatgattttaggtaagaaactttgataatattggcataatttagatttattttctttcttttttttgagacagtctcactcagtcgcccaggctgaagtgcagtgacacagtctcagctcactgcaacgtct

SEQ ID NO: 10178 - DNA, 1191 bp, Homo sapiens
gcatgctccaggaacccacgttgagggaagcagtgcatgctctcttcagagggtggtggcttccaattgttttccatctttctacccaacattcaaaaatcaaagtgtctggccgggcatggtagctcacgcctgtaatcctagcacttttggaggcaaaggctggcagattgcctgagctcaggagttcagcaccagcctgggcaacatggtgaaaccccatctctactaaaaatacaaaaaaaaaaaaaaaaattagccaggcatgatggtgagcgcctgtaatcccagctactggggagtccgaggtgggagaattgcttgaacccgggaggcagaggttgcagtgagctgagattgtgccactgcattccagcctggggagcacagcgaaactccatctcaatcaatcagtcaatcataattttattcatcttttctacagagtttatataagtaagtttaatctttttattttcatgtgtctgatggttttcaattattttcatccttttctgtgtcttaggtatatttgaaggctcccatgattctgaatggagtctgtgttatctggaaaggctggattgatctccaaagactggatggtatgggctgtctggagtttgatgaggagcgagcccaggtagggtaacatcaggctttattgagcatggtccctttagtccctaatcttgcctttgcctggggacctattttacccaatttttaagagtaagtatagaaagtattgtgttgaagcaatattgaggaatcctgaaaatgttgatactcaaattctgatcctgattttgggaaagttttttcttcagcagttctaaatttcatgggttattcgtatctgctcagtgggtgcttcaaagtccagcaagtagctctttaaaatatttattcttgatctttagaacactatgaatagggaaaaaagaaaaaactgttcaaaataaaatgtaggagccgtgcttttggaatgcttgagtgaggagctcaacaagtcctctcccaagaaagcaatgataaaacttgacaaaaattgtttaaaaaaaaaaaaaaaaagctggacgtggtggctcacacctgtaatcccagcactttgggaggctgaggcagacggatcacctgagacttgaggtcaggatttcgagaccagcctggccatcatgatgaaacccc

SEQ ID NO: 10179 - DNA, 1172 bp, Homo sapiens
gcgtgcctgtagtcccagctgcttgggaggctgaggcaggagaattgctgtaatggggttaagcctatgattttcaggttgtggtgagctatgattccaccactgcacttgtactccagcctgagtaacagagcgggatgctgtttctttttttttttctttttttttcttttcctttttttttgagacaggctggagtgcaatggcgcaatctcggctcactgcaaccttcacctcctgggttttaagctattctgcctcagcctcccaagtagctgggattacaaacatgcgccacaacatccagctaatttctgtatttttagtagagatgcggtttcaccatgttggtcaggctggtgtcgaactcctgacctcaagtgatctgcccgcctcggcctcccaaagtgctgagattacaggcgtgagccactgcgcccggccactgtttcaggaaaaaaaaaaaaaaaacaaaacccaaatattgtattttttttataaatcaaaattaaaataggtatttcatgtattctgacagcaggaggatgcattagcacaacaggcctttgaagaggctcggagaaggacacgcgaatttgaagatagagacaggtctcatcgggaggaaatggaggtgagagtttcacagctgctggcagtaactggttagtactttcccccaaactctcaggctgtgtttgtgatgtttgtgcataatgctttttaatagtttaattttgtctttcatttttaaaaagttgtactctctggctttgtgtttattaaatgtaattgctataaagaaatttattttaattttaaagttgtacatcaattcctcattcattggtcttcataaaaatcatttactataataaggtatattttctcttaattcatttactcaaaatctcacctctttttttcttatttttcaaattatttgtaaaaatcagcttatgttaacagattgcatatttttagaacattattaaaactcgagtaatactactttccatttttctatgaatatttgtcttggttttataactataattgtcagtcatttgtgtgattttaactaaaggaaaatttaatattcaaactattcaaagaacggaattaaactttttcttttaacctttctattgtaaaatacagaaacagaaatc

SEQ ID NO: 10180 - DNA, 2267 bp, Homo sapiens
ttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaacagggtcttggctctttcttgacctaacccagtaatttctaagaaagcaacaacagtggcatctagtggtaatttctgttgattccaaagaagactactttaaatataggtatcacaaggtatacaaatcccccagtgtatattatggttttcaagaaatctggcttgatttacccatcctgtgagatatgaccataaagtagtgatgttgggagaaagaattttaaattacacatccaaattagttccatctttcaagctagttgttttggaaatatacagccgttttgattgtgctggtgttatatcaaacattcttaagactcctggcattttcctacaacagaaaagtaagcccttttccttgaaagtatgccttaagcttgaca

SEQ ID NO: 10181 - DNA, 2326 bp, Homo sapiens
agagggtgttgggggccctccagtggcatgtgaacaaatgcattgtaggggagtgagtggctctggaggccctgctgacttgggagaacagcaagctgcccttgttttccctgtggatgcagtatctccagcagacacttaacagttccagaaggactggacacgtggccatggtaaaggctgtgtgtaaccattgagaaacaggcagatctcaggcagaggggggcctttagcatgaaccaggggaggttgaggagtcgggaaacccagccattaggtgcaggtatgtcacacaacctccagccctcatgcacaggatctgcctacatccctttacctctcccccttgacccactgtcctcttctcacaccaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctct

SEQ ID NO: 10182 - DNA, 1212 bp, Homo sapiens
tccccactccctctgcagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaagtagtagtggcttacacctgtaatcccaacaatttgggagacagagataggaggattgcttgagctcaggagtttgagaccagcctgggtagtcccagccacttaggaggctgaggtgggaggatccctggagcatggaaggttgaggctgcagtgagatgtcactgagctactgcactccagcctgggtgacagagtgagaccctgtctcaaaaaaaaaaaaaaaaaaagaaagaaaaaaaaagagaagttgtggaggatggaggaaggggcctaacctgggcaggggacagggggtaggcttcctggaggagatgagtgtgagtaggcataggggtgggctatcgagagaagggcagtgttcggggcacagtctcaggcaagggcttgaggaaggcttgtgggtttttcaat

SEQ ID NO: 10183 - DNA, 1773 bp, Homo sapiens
ctccccaaagagctgtcagaaatctttgatcccacacgaggtaggctgctgcattcctccctgaggctaggggtaagggacacagctcattgggtcctatggctgttttcttgcccttttgaggaccttgttgtggcgcttatggtaactggggcaaagggtgaagttcctgatgggcaggtggggttccctttcctgggctttggtgggtggagaggtgggagctggaatgttagtaactgagctccctccattcccagagtgcatgagctcggagctgctggaggagttgatgtcctcagaaggtgggtggccctggaaggtgggagtgggtgtgggcaggggttgggctgctgctaggggagccctggcccagggcctgagactagtgctctctgcagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggctagctctgatgtggttctttggggaccctccttgggactgtgctggactggcagtgtgattgggtgggtcaccttgctggaactaggggtggggcggcctccggcagcctgccctccccgcccccacctgccgcaccttggtgtggggcggggccgcctcggcggggcggggcaggcggagccgtcctaccttcctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccat

SEQ ID NO: 10184 - DNA, 1773 bp, Homo sapiens; identical to SEQ ID NO: 10183

SEQ ID NO: 10185 - DNA, 1131 bp, Homo sapiens
gtcaggagctcgagaccagcctgaccaatatggtgaaaccctgtctctactaaaattacaaaaattagctgggtgtggtggcgtggtgtgcacctgtagttccagctacttggaggctgaggcaggagaatcgcttgaacccgggaggcagagatggcagtgagccgagatcgcgccactgcaccccagcctgggcaacagagcgagactctgtctcaaaaaaaaagagtttgacggaacatgaagaaggacatccagaggagactggtggtgtcagggaaggcttcctgaaggaacaggatgagaagaaaggttgggcttctgggatcagtaatagcataagtgaaggcaccatggtgtggaaccaatcacacaagttccatttggctggaactaagtgagacatggcaggaggcgaggctagaatggcatcaggctgcaagctggcagatgtgccaggcagcagagtttggctttctcctggtgaccatcaaggagcccattaggcaggcaagtgacacagcgtgatttgtattagaactctgcagtgcagagtggactgggagagtgagacagcatagggaggaggccagccaggaggtgaatgcagacatctgggctagtttgaaaggcaggcagtgatggctcattgttttaattttgatttgtttattagtgaggttgcactgtttttctcattagttcacccttcatatttcccccttttgtttattcatgttctgtatccatttaactattaaggtcttagtatttttctattccatttgtatggactttttctttttctttttttttttttttttttttttgagataagagtcttgctctgtcgcccaggctagagtgcagtggcgctatctcggctcactgcaagctctgcctcctgggttcaagcagttctcctgcctcagcctcccaagtagctgggattacagacacacgccaccatgcccagctaattttttttttttttttttagatggagtcttgctctgtcacccaggctggagtgcaatggcgcaatctcggctcactgcaacctccgcctcagcaattctcctgcctcagcctctcaagtagccagaattgcaggtgtgtgccaccacactt

SEQ ID NO: 10186 - DNA, 1104 bp, Homo sapiens
ccagaggcaggagggcatggcttggggtctggggcttcccgtgctgacagttcacccagtctccctccctagctgctgaggactcagagatctcgtcccaatgcccatcagccagtggctccagtggctctgacagcagctgtgtgtcagggcaggccctgggtaggggcctggaggacttaccctgtgtgagtgccatttgccctatacccaccagcccttccccagcccaagctgagcctgtgactgtgaccagcccctccccagcccaggctaggcctttactttgggtagagcttggggtgggtgggccagagccattccccagacacctcctgggtccagagtcagggaagcaggcattcatgcctggcctggccctgcaggtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgcattctgggctatctccaatta

SEQ ID NO: 10187 - DNA, 2149 bp, Homo sapiens
gaggtgagggggtgaaggagactgtagcctgaagcagacagtcgggtgggccctgccctggcactcctgggtgggaggctgtgggcagctgccacttggctgattcacagaagtgtttcattggctttgctgtaagggctgccccggcccatccatgggtgtgcttgtacccaccttgaaaggggctagggaggggaggagggagctgtgagggcttgtgcctagcaagccctccagagcttccttgcctgtgctgagcaagctccatactctctacaggcctacctggagtccttctacaagttctgcaccctactgggcgggactacggctgatgccatgtgccccatcctggaggtgagtgcctgcccgccctcctgcctgctggtgcccgctagccctggcctggggaggctctgccaactgactggctactgcctccttcttcctccctctcttcttacctgtgcactggctccacagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggtgagtgccccggctggcaggacagcggttggatgtgttgtcaccaagcacccccacccagaaccctcatgcttgtgcttccccccacccccctggccaggagtacaagctgctcttcgagggtgcaggtagcaaccctggagacaagacgctggaggaccgattctttgagcacgaggtgagtctgcagggtctgcttgtcagagggaggccaacctggtggtttagacctgactctgtggccatggccacctggacaccacatctgcccgtgtccacaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaactgtctgctgtctcgtttaggccctggtacctctccatgacccctaacttccctcgtgaccccaccttgctaagcaaccctgcctaagcctccacctccctccctcagtcagcagccgagattcttcagggttggggagtcccagggagatagccccttcttctgctggaggctcagatgcatacaggcctggggagctagatgttggccctggaggcccccctggcctccccagttgcttcaagcaattgggatcagtgtcattacccccatttcactatgaggaaacccatggtctgaaatgatttgccccaggtcagtggaggagggggaggtgtgaaccagagtctaccaggggaatcccagcctccacgctgagccccaggagttgccaccctgtcacacggccacactgtgtcactcagccagccagtcagtgaccccctccaaacagcacctgccgcattttagaagaaataaaaatttgtctttatttaaaatgtggcaattgggaagtacagtacatgcttccctgtg

SEQ ID NO: 10188 - DNA, 1154 bp, Homo sapiens
cacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatggtgaggagggctgggctgggctagggcaaccagggagggcagccagggggcggcagccgctctgatgcccttcacaacctcagcagagacaaggtctgactcgcagccgggcctccagtctcagcatcactgtggagcatgccttggagagcttcagcttcctcaatgaagacgaagatgaagacaatgatgttcctggggacaggtgagggggctaggcaag

SEQ ID NO: 10189 - DNA, 1212 bp, Homo sapiens
cccactccttctcaaccccgactctcccagaggccctggcccctcaactgtcagtcctggagtggcctttgctggttcccagttgagagttgtgccaggtccctccttcctctgctgctgcccaggctacagccccatgccctgcaccctttgcagtccacttgtcataaaccatcccgcctgcagcctactcctacccatgccatccccagtggtcccagctggaggtagcatggcgcagactgactccagagatccctactaccacctgctggtcccagccccttcctccttctggaaatcctccatgaacttaccccactgtctgctgtcggtgcatcatcttcttcctttctggcatgggggaagcttaataaaaataaacgctggtgaccaggtggtgatgtgtgcctgtggggtggtggaccccatttttccctcaggcctccaagcagcccggaggctggggctgaggacagcatagactcacccagtgcccgccccctcagcacggggtgtccagctctggatgctgccttggtccggcacctgtaccactgcagtcgcctcctgctggtgaggctgatggtgttcccccacccttcctttgtaacccctaaccccagggagtcctgcccttccatcctggtcctctatacctcctctgagtgccacaccccagtgccccagggcccttggcatctggcccttgctgaatggagtatctcccaactctgcaaccccaacctcccccagtgcatgctgggacttgtccctgagcacgatcctcccgagccctaccctgaggcctgagctacttggccacccatgttctccagaaactgggcacatttgggcccctgcgctgccaggaggcatgggccctggagcggctgctgcgggaagcccgagtactggaggcagtatgcgagttcagcaggcggtgggagatcccggccagctctgcccaggaaggtaaaggccctgggggttcgggctctgccatctgccttgaagctcctacctcagcctactgccatctgcatgctctctactcacctgcctgcctgttgctgacggtttccctcaccccctcacagtggtgcagttctcggcctctcggcctggcttcctgaccttctgggaccagtgcacagagagactcagctgcttcctctgcccggtggagcgggtgcttctcaccttctgcaa

SEQ ID NO: 10190 - DNA, 1114 bp, Homo sapiens
cccccacttccccaaccctgtacgggttcagggggccggagacagcagctagggaataaggtcaagcggactggatccggcaccgcccaggggcggcggcctccgcccaggaagccccacccagcgggagccaggacgccgcggcgccggcagagcccacgagcgacccggcgagggcgcgtgcggcgtgacgacgcgactcgcggcgcgtcccgtgacgccatcgcgcccgcttttgaaagttggcgcccggggccgcctcccatgctgccctgcgccaacccctcccctcacctttcctcccccgccctctactcgccgcccggccggtccccccacccgtcccttcccttatcagcacccgcggccccggcagcgccgacgcaggcgcactgcaccgcgccgccgccattttgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggaggtaagggggcccggggtggaggaggtttcgcgggccgcctctaggtgtcacgatggggccgctccggtcggcgctggctgcagcccggcgccagcgccgccgccggggggtgtttgtctccctctaccgtccctgctgcggcgcggccgccgccattgcccgtcgccgccgtggcccggccgccccccccacccccacgcccgcccgcccgcccgcccgctaggcctccctcctggcagcgcgctaggcctcgggcggcggcagaggcagaggcccgcgcgcccggcgactccattttccttcctttgtctgccctcgaggccggttcttggccggccgatcgcccggccgcggcccgccctctgtcctgtgtcctccgcccctcccgcggcgggtggccccagctgagacactatctccgcgtcccggcttcggcgcccgcctagcttaagggttcggaccgactgccgccgcgcgctaagccaggtcccggtgccgtatgggtgtcgggccctggccgtcgcgtctcgggctg

SEQ ID NO: 10191 - DNA, 1105 bp, Homo sapiens
ggcgggcccctgtactcccaggaggctgaggcaggaggatggcgtgtacccgggaggcagagcttgcagtgatccgagatggcaccactgcactccagcctgggcgaaagagcaagactccgtctcaaaaaaaaaaaaaaaatttccttaggtggattgaaacctgcaccccaccctaccccacccttagctagctgtagcctgttctgggtcttctcttgggggctctgttagatcttgacagaactaagagctggtctgatcctcccccgtctctgtctgcaggctgctgagcctccccttagagaacccagccttatccatttcccctgagcagagacagcgtgttcaggacacacttagcagatactagaatttttaggcttaatatggattttattaaagtaaataacttccaatctgatcttagcttttttagtggtgtgaaagaggattttgttctttttgttagaataccatggcaagacatgctgataattgtgctggcccagatggcgtagagggggaaaatggaggagaaacgaagaagagtaaacgtggaagaaaaagaaagatgcgctctaagaaagaagattcctctgacagtggtaagtgacttgttccttgatttgcttactatggcaggctttggagcccagtttccagtgtgtttatgtatggatatgctgggatatagaggcgggcacacactcttcctttctttaaacttctcatctcctaacgtctatttacaacagcagttagtgtttttctggggcatattttcttttttcttcgtggcattccgctcattaatgcccttttttttttttttttttttttttttttttttttttttttttttttgagacggagtctcgctctgtcgcccaggctggagtgcactggcgcgatctcggctcactgcaagctcagcctcccgggttcacgccattctcctgcctcagcctcccgagtagctgtgactacaggcgcccaccaccaggcctggctaatttttttgtattttttagtagagacggggtttcaccgtgttagccagaatggtctcgatctcctcacctcatgatccgccctcctcagc

SEQ ID NO: 10192 - DNA, 2148 bp, Homo sapiens
ataaaaaataaattgactgtctctggaccgctatctaataaggctgtcctgcattgctgacatcccgttcgctgtcagtctaaaagacccttgtgattcttggggctttaatggaccatttgttctgtctgtgctcttctttgccagcaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgctccaaagactccatcttgcgtgattcctgcctgcttgagggaggctggggggctgcatacatggttccaggctgtgcaggctgctgcctttcacaggcaacctctgttccctgggatggtactttctctagcagatgggacgatatgatcttggcgggtgactggatattgagcgcatcctgctgtaactgtttttttgttttgttttgttttgttttgttttgtttgagatggagtctcgctctgttgcccaggctggagtgcagtggcgcaatctcagctcactgcaacctccacctcccaggttcacgccattctcctgcctcaacctcccgagtagctgggactacaggcgcctgccaccatgcctggccaattttttgtatttttagtagagactgggtttcactgtgttagccaggatggtctcgatctcctgaccttgtaatccgcctgcctaggcctcccaaagtgctgggattacaggcgtgagccaccacacccggcccct

SEQ ID NO: 10193 - DNA, 1129 bp, Homo sapiens
agtggaaataagagcacacacacagcgctaaataaatggtacttccttcgccctcccctcggattggcggagccctgctccccagactccgggggcgcgcggacctcagcgtgatgacgcaagagcggaggacggctcctctccatccacggctccgtttcctaggaaacgtggactccgcgttccactctgcgtcgctgcccccttgacgtcacgctccggatgggaaggcggggcgtgtgctaccgccaggggcggggcggcgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaagtaagggctcctccggcctcggccctaggcgctcccaattccctctttctccccttcccagctccttggtccccgccacctcttccctctatcctccaagtcccattctgcttttctgctcgccttcccccatccgtcttccttcctccactgctggtctccagctctctgtggcctgagtacctggagggcggtaagaagaccttggacagcgtccctggtactggagctgaggtctgggcttaaggctgccgcaaaagcggcagccgcatctttcccattcctgccagcctgcggtgagaaaggggcgcaggctgtcctgactcctcctctcccccaaccccgacttccagtttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcggggtgaggaggggtacagtgggcagcctctgtggggtaaggtgtctgtggggcaggtctacaagggttagtccatgcccagggtacccaagcgtcaccctctgcagtccctgcccttggcttgacctctaagtggtaggaaatagctac

SEQ ID NO: 10194 - DNA, 3185 bp, Homo sapiens
ctcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagcagtcatgtgtgtctggtctctgttttgagtcttactgaggttggcaccccttctgtgacacatcctgtcctaaaggatttgggcccttcccagcctctcaagtgcccaggccctcaggtgccttcttcaaggacctttgaaactgtgtatttgtaagaccccaaagaggacaggtacttaaacctcagttctctcttgaaacggctttcttcttatacaaggaaaaagtagcaaattcaactaaagagcctgggcacagtggctcacgcctataatctcagcacgttgggaggctgaggcaggtggatcccttgagctcaggagttcgagaacagcctgggcaacatggcaaaaccccatctctacaaaaaatacaaaaattagc

SEQ ID NO: 10195 - DNA, 1361 bp, Homo sapiens
gcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttttatttgggtctcgccattttatttttacaaaaacatagttaaatgtccttgaaacatggggaaataggcctcagcctttctgaaagaccaggctgaccctgaaagtagagatgcttcaatgaccagtttttccaaaaatgggccctaagcacatggatcctggccttataaggtcctcacagagttcctggcccagctcaccctaaagagtttggaaactgcaccaaatgggcccagtttgtccatggattatctccctgtatcctttcaacaagaaggaccaactggtaactaagctatattgtgatag

SEQ ID NO: 10196 - DNA, 1215 bp, Homo sapiens
ttctgctggatgtcccacagagccagttccaacatcaggccactcaggccttaggggtacaatggaaggtttgtccatgctgcctcttggggagctgggtgggaaaaccaagcttgagactctggtggtggcagggagacaggtggggcagcgcttctctgctactgcctgagcctggatacgtattcatggtccactgctctcctgattccagctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcagtatccattccttcctgtgggtggtgggactgaagaagggtgggcggagctggggtgtcacgcctcttcattcatctatctagcccttaacaccctgctcagagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggtgagggggctgacatggcgaagaggcgccagagaagccatagtgtggggttgggctgcacactcacctccctgtgccttccaggctgaggtgtgggacctggacatgctccgctccagccacagtacctggcctgtggatgttagccagatcaagcagggcttcattgtggtaaaaggtcatagcacggtaagcctgtgactgcctgcctcccctgccctccccacttcctcatatccatcttctgttccctatatccacagctgcccgggcagctttactagcattctgcccgtggggactctgagctcaaattggccctcacctgtgcagctttctccttatctagcagcaccctgcaggtctggccttctctaggaaccctgttcatttagtcagtcacacaagcatgccagtcccaccgtgagtcagcccagctcattgccatcctcacttgggaggggcttgttctcacctctagtcagcaaagctttttgggttctttctagtgcctcagtgaaggagccctctctcctgatgggactgtgctggctactgcga

SEQ ID NO: 10197 - DNA, 1099 bp, Homo sapiens
cttcttggctgtggcctcgtttttgacctgtatccccacttccctgctgccctgtctctcattactgctaatactaatgcctcgtctctgtgccccccatctctgcctcacttcctgtcacttaagcccccatctttggcccacctcaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaaggtgaggagcttgggaggggaaaagtgtgctagcaggaggggcttcagatagattcatccatggctaagttggcctgtcctcccagccccaggaatggccttcaggaaaagcacaagagcctggccttccaccgaccaccatatcacctgctgcagcaacgtgacagccaggatgccagtgctgagcaaaggtgggagccactctacaccattgccctcatggggggatgggcagcaagtgggcaggggcttactcctccttccccttcccacagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatgggtagggagaaatcctagggagggagagggtggtctctaggctgcctcacatagcctgaggtgcttctcgcctatggcagggatgcagcc

SEQ ID NO: 10198 - DNA, 1843 bp, Homo sapiens
cagggggctgtgactccccctgaactgggagcctggcctggcactgatacccctcttggtgggcagctgctctggtggagttgggaagggataggacctggccttcactgtctcccttgccctttgacttttccccaatcaaagggaactgcagtgctgggtggagtgtcctgtggcctcaggaccctttgggacagttacttctgggaccccctttcctccacagagcccttctccctggtttcacacattcccatgcatcctgatccttaagattatgctccagtgggagaccctggtaggcacaaagcttgtgccttgactggacccgtagcccctggctaggtcgaaacagccctccacctcccagccaagatctgtcttccttcatggtgcctccagggagccttcctggtcccaggacctctggtggagggccatggcgtggaccttcacccttctggactgtgtggccatgctggtcatcggcttgcccaggctccagcctctccagattctgaggggtctcagcccaccgcccttggtgccttctttgtagagcccaccgctacctccctctccccgttggatgtccattccattccccaggtgcctccttcccaactgggggtggttaaagggagccccactgctgctacctggggaatggggcacctgggggccaaggcagagggaagggggtcctcccgattagggtcgagtgtcagcctgggttctatcctttggtgcagccccattgccttttcccttcaggctctgttgctccctcctctgcagctgcacgaaggcgccatctggtgtctgcatgggtgttggcagcctgggagtgatcactgcacgcccatcgtgcacacctgcccatcgtgcacacccacccatggtgcacacctgtagtcctccatgaggacatgggaaggtaggagttgccgccctgggggagggtcccgggctgctcacctctccccttctgctgagcttctgcgcacccctccctggaacttagccatactgtgtgacctgcctctgaaaccagggtgccaggggcactgccttctcacagctggccttgccccgtccaccctgtgctgcttcccttcacagcattaaccttccagtctgggtcccactgagcctcaagctggaaggagcccctgcgggaggtgggtggggttgggtggctgctttcccagaggcctgagccagaaccatccccatttcttttgtggtatctccccctaccacaaaccaggctggaacccaagccccttcctccacagctgccttcagtgggtagaatggggccagggcccagctttggccttagcttgacggcagggcccctgccattgcaggagggtttggttcccactcagcttctgccggtcggcagcctgggccaggcccttttcctgcatgtgccacctccagtgggaaacaaaactaaagagaccactctgtgccaagtcgactatgccttagacacatcctcctaccgtccccaatgccccctgggcaggaggcagtggagaaccaagccccatggcctcagaatttccccccagttccccaagtgtctctggggacctgaagccctggggcttacgttctctcttgcccagggtgggcctggtcctgagggcaggacagggggtttggagatgtgggcctttgatagacccacttgggccttcatgccatggcctgtggatggagaatgtgcagttatttattatgcgtattcagtttgtaaacgtatcctctgtattcagtaaacaggctgcctctccagggagggctgccattcattccaacagttctggct

SEQ ID NO: 10199 - DNA, 1173 bp, Homo sapiens
gtgggcggagggccacagactggtggtcagccgtgctcctcctccccagacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtagaccagggggtgggtgcagatgagaggggctaggcccttggaggagcagctgtgaccaaaccgcccacctggtcccttgcctcaggtctggaggaagtgccggatgcgcatcttcacagtggcccagatggatgacaacagcatccagatgaagaaggacctggctgtctttctgtaccatctgcgccttgaggccgaggtggaggtggtggagatggtgagccctctgccctgccctggccccgtggataccatgtcccgtgcagctgggtcctcacggccaaccctgtccccagcataacagtgacatctctgcatacacctacgagcggacgctgatgatggagcagcggtcgcagatgctgcggcagatgagactgaccaagactgagcgggagcgagaagtcagtgccctttgtggttcacgccagggcgggtggcagggtcaggcctttggagaccgcatcggtgggtgcggaggaatcagaatgactcaccgcagccctacccaagctagtgctcatttcccggaggcaaggtggtcacattgggccagacaggccccatcccccttttcctatgggaccaaggctatctcctgcaattgtcctcaggcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccgtgagtgcagcaaaaacagccccagcggcactggaatctaggggtggaggtggggtggggcagacaagtagtgttagatgggccaggggtggggaccctccttgcaggatggctcatggcgacctgtgactggctacactacgtgtagggac

SEQ ID NO: 10200 - DNA, 1556 bp, Homo sapiens
aaatgacaataaaaagtaaccaggagtgtggcatgtacctgtgtcccagctactccagaggctgaggaaaggatcacttgagcctaggatgggaggttgaggctttagtgagctatgatcacaccattgcactccagtctaggtgagagagtgagaccctgtctcaaaaaaaaaaaaaaaaaatctttttcagggcataatgtttcctgattatctttttagaaaatgtggacataaaaaggaaaaattacatatgtaattgtatatgtaataatcacacatatctgcagaaataaccagatgcattgaaaaaacacacacatgccacttctttagtggagctaatgacatacattttatatcccacttttttctctcgagattgttattatttactttctcatctagtaatttatacatctgagttttctaatttcttgttttgttgggtttttttttttttgccttcctccccgtagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttcttt

SEQ ID NO: 10201 - DNA, 1119 bp, Homo sapiens
tgtggtggctcaagcctataatgccagcactttgggaggccaaggcaggaggattgtttgaagccaggagtttgagaccaggctggacgacaaagtgagaccatgttgctattaaaaaaaaaaattagctgagcatggtgtcatgcatctgtaaccccagctacttgggagactgagatgggagcatcacttgagcccaggaactggaggctgcagggagctaggatcacatcactgtgctccaatttgggcaacagagtgagaccctttcttaaataaatatacttagaaatcacattaatatatctattttgttttataaacagcttagttcttttagtgtgttttgttgccattgtcttgaattttaaaagcctaaatgaatcccaaaatttgcttctctttattttctttttgtagcttgagtttgtcatttatgtatcaaagatttttaactaatattttgttttttctcaactctttaaaaaaatttaaaacagcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaaggtaagtaatatatgagttgattgacttcaaactaaggggcaaagggtaaaataaattatttagatgtttctgtaacaaaaattacaaagtagttttcataaagctatgggtgtcattttgcacttgattttattttaaaccaaacatttattaaattttcatataaatgttaaattatctttaaggagctgggcatggtggcatgtgcctgtagttccagctactcagaaggctgaggcaggaggatcacttaggcccagaagttctaggttacagtgagctctgattgtggcacttcactcctcagcctgggcaacagagtgaaaccttgtttctaaataataatgtaataataataatttaagatgtctgaaaagtagaattcccccagcaactctactcctaagtgtttacttgaaagggttagaaatacgtgtccgtacatgaacttagagacaaatatttatagcaactttat

SEQ ID NO: 10202 - DNA, 1109 bp, Homo sapiens
gagcaggcttcagacactgcctttatctttacagaaagccatgggaagggaaatgtctgaggtagagctcagcgttgggcatcatatggctaatcactcagaggtcactaatcactctcccttttcttgtttttcagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtgga

SEQ ID NO: 10203 - DNA, 2163 bp, Homo sapiens
taggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaagttggcagaaagtcctcccctttaaaattcaagcctgaaggttttgtgtgggggcctactgccccctaatgtcttctg

SEQ ID NO: 10204 - DNA, 1162 bp, Homo sapiens
tatctccacagaatgagctatttggttttaaatcctttgttgataatttgtaatgaaaagattattgaagtttaaacacatttgaccttgtcccaggaccctaggccctaatccttgccttctaggattcttttgttccagaagctaatgctgtcttatgtctggatggatccattttgctagtttccaggtccaacacctgacttcagaggcctgaaatgctacaatttctccctctggctcaaaattcttccatggggagagagttagattccattatttattgacattatttagtccagatgggtagggatccaattgctagttagcatttctcaggcctgaggacagtgagatggttctgaaggcgtttcccccatttgtatgccaggcagtcgggacccaggtctaacccctctctaggacaccgtgtaatccatgttaaggttgctgcactgaagtgaggagggcctcagcgtctgcctttttctaaagtgcttgcaacaagggggaggcattgagtggaggaagggctgcaacagaagggggaaagatgctaccctgagggttaatgtacctcagggtacatcaaggaatggacctatctgatgccaaggggtcaatgaaaagagccagaggtaatctggtgaagtggcatcagatctagtactgactgctgggtgggggagtctcctgggggcgcaggtggtgacgatgctcacctgtctccccacccctttcccacagtgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaaggtcagcagctctggccagactaggaggggtgggccatctccctaaggtggcttcttgcccacgagctgtttcctcttcccacgttacttaatctctcaccccctctatttcagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtc

SEQ ID NO: 10205 - DNA, 1106 bp, Homo sapiens
cccctgagccactctggcagattgctgctcttggccacattgtgtcttcctaaagccagcagggttcccgcaaacttttgggccactggcctctgagtttagagtttatttatctccttggccacaatagccagctgtagtctacattgtggacgtcctgaaaactggcagttctctggcatttggctcctggattagaagcattgctcatactgcagctcgttgacagctgactctgttctccgtttcagtggcgggaccactggatgcagtgtgtgtacttcctgccacaagaggagcctgtggtgcagggctcagcgctctatctggtagcccaccacgatgactactgcgtatggtacagcctgcagaggaccaggtacgtcgagcctcgtgggggtggaggatgagcctctgagacttgtatgtaaattccccatttacagatcctctggaggtgccagtgggttgatttgtgtctggacagaataacataagaacaaagatttgtgaccagtgtgtcagtgcccattcgtgtgtacccaggagaggctgtcatgggttgctggaatctgtttagagcagatgcgtaggaaaagtctggaattagcgggtgctctaagccctcatgcctactggagaccagtgtccagattcatgccctctggagacctgtggaggcgctcacagcccacgtctgtttgttcatctcctggcctagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtaagtgtccagccccttggcttgttgtggggaaaagggagaaagaagtttgtcccatgaaccccagcactttgcttatgatttgctgtttctttcctgtgtcctcttgtctatgagtggcttcagcgagcgcctcctgggtgggcactggagcagaaagcgggagagcctggggctggacttcctgagggcttgctctctgctctactgggagagcctctggctgggctcctgctggacacctttgcc

SEQ ID NO: 10206 - DNA, 1211 bp, Homo sapiens
gcccttaccccctggcctgtgttgcactgagcacttgctgtctgctggtccctgagtgaatgaattctgcatgaataacgcattctttcatttctacctccaaaacctttaggggaggggagagaggggctcacagagaggaaatggaggcttgcagctggcaagaggcaggacccgccgctcctaactacctgttctctgttgccgcagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaggtgcctggggagtgaactgttttctaaatagaaggtttattggcatctaactcacataccataccattcacttgtttaacgtttacaattcaatggtttttagaattttcagagttctgcaaaaagagtgggctctgtttaccctgctggc

SEQ ID NO: 10207 - DNA, 1232 bp, Homo sapiens
tgtctctctacaaaaaggcaaaagaaaaaaaaattagcctggcgtggtggtgtgcacctgtactcccagctactagagaggctggggccagaggaccgcttgagcccaggagttcgaggctgcagtgagctgtgatcgcaccactgcactccagcttgggtgaaagagtgagaccccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccataacccacctagaccctagcaactccaggctagagggtcaccgcgtctatgcgaggccgggtgggcgggccgtcagctccgccctggggaggggtccgcgctgctgattggctgtggccggcaggtgaaccctcagccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtaccccggatcccctgacttgcgagggacgcattcgggccgcaagctccgcgccccagccctgcgccccttcctctcccgtcgtcaccgcttcccttcttccaagaaagttcgggtcctgaggagcggagcggcctggaagcctcgcgcgctccggaccccccagtgatgggagtggggggtgggtggtgaggggcgagcgcggctttcctgccccctccagcgcagaccgaggcgggggcgtctggccgcggagtccgcggggtgggctcgcgcgggcggtgggggcgtgaagcggggtgtagggggtggggtgtggagaaggggtgccctggtgcaagtcgagggggagccaggagtcgtggggacgatcttcgagggaaggagaggggcatccgtagaaataaaggcacctgccatgccaagaaaggtcgtaaataggagtgagggtcccggggataagaaagtgaggtcggaggaggtgggagcgcccctcgctctgaggagtggtgcattcccggtctaaggaaagtggggtac

SEQ ID NO: 10208 - DNA, 1329 bp, Homo sapiens
gctgggattacaggagggagccactgcacccggcctacaagaggtcatttgtttttgttttggatttttgtttttttgagaccgagtctacctgtgtcactcaagctggaatgcagtggtacaatcttagctcactgcagcctggaccttctgggcccaagcgacactcccaccccatcttcctgagtagctgagactaaaggcgcaggccaccacacccagttaatttttgtattttttgtagaaacaagatcttgctatgttgcccaggctggtcttgaaatcttgagctcaagcaatctgcccacctcggcctcccaaagtgctgagattacatgaaccactatgcctggccaggaagtcatatattgatgccaaattcagaaatatctgggggaaatgctagactaaaaggaccagagcaagtttcacccggcatggaataagagtttttcaggcccgcatcttcatctctaggcctgatgccctggtcctcgtgtgggaaatgggaggtctgagccgtggggggtgttctccagcccatggctcttaccttgttataatctcactgaagcagcagcagcacatgtgtgagaaaagtcacccactgggggtctcagagcctaggaaggtgtggcagccaggggggcgcactctgctctggctgggccccttctcccatgttttcttcctcatcagagctcaagtcaccctcacttggttctttcagctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggtatatccactaatgagaatctgaatactcagaaagactcttaggttctttggaccccaaagtgttgtccaagcccaaaggttgtgtaactaaagctgatccttcctacggacagaacttcttggcaagccattgttgtgttatatgcatgtgtgtaacagtctacctgtggaaacatataaaatagggagagtttaagaacaatcttcccttttttattattaattttttttttttttaggctgggcatggtggctcatgcctgtaatcccagcactttgggaggccaaggtggatgggtcacctgtgctcaggagttcaagaccagcctgaccaacatggtgaaacctcgtctctattaaaaatacaaaaaaattagccggtcgtggtggcgggggcctgtaatcccagctacttgggaggctgaggcaggagaattgcttgaacccgggag

SEQ ID NO: 10209 - DNA, 2050 bp, Homo sapiens
ataaatgtacgttgttggtgttcactgctccgtggtgtgccacaagtctgggtgcattgtcgtaccttacatattgctagacttcttgccccagatgacaggtgtgcccttcctttcactaaaagatgcttttgtcccttcttctttagaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagg

SEQ ID NO: 10210 - DNA, 1136 bp, Homo sapiens
cttgagtgcagtggcacaatctcggctcactgcaacctccgcctcccgggttcaagcgattctcctgcctcagcctcgtgagtagctgggactacaggcctgccccaccacacccggctaacttcttatatttttagtagagatggggtttcaccatattggccaggttgatttcaaactcgtgactttgtgatccgcctgccttggcctcccaaaatactgggattacagttgtgagccaccacacctggcctaaaatgaaaattctaagtgataatgtgctataggtaattggcaacgttggtgttttttcttagtgatacataaaataacaatgcatgtttataatcagtggcatcatatattccatgaaatgtgtatgaattgtgtattgttcaatgataaccattttctgatcttaggtgttacttactgagccatctttctagtaaagcttccttccttagctttagtatgtcctattcagtgaggcactaaatatgggtaattttgtgtgtttattttctagagctttcagagagtgacatggtaccaggaactattttggtgacagaagaagaacttagtagatgcattgaggatgtgtttaaggttggtaatctgagtcactaatgtttttatttacttcttatttaaaattttttttaaattttttctttttttgtagagatggtggggtctcaccacgttgcccagtctggtcttgaactcctggcctcaagcgatcctccttccttagcctcccaaagtgctgggattacaggtgtgagccgctgctcccagccttttaaaataattttaccttttaattagcacttgaaccgttggaatgactaatctaaagctccaagctgtctggttttcactttgaaaaccagaaactgtaagctgacgttttttgtcttttgttgttgttgcttttcctttttgtggagaatgaggtctcactatattgcccaggtaggtctcgaactcctgggctcaagctatcctcttgcctctgcctccctaagagctgggattacaggcgcgagccactgcgcctggcaagctgacctttttaagtgaaaaaactgatatatttttgaaaccctgttaattacatcatttattct

SEQ ID NO: 10211 - DNA, 1183 bp, Homo sapiens
actcaagtcctcacagcactgtcatgttctcatcagagactgacaaggaacatgtgaacgatgatttagttcctcttctagttgattggcacagatgaaaggggttgaggaatcagcaatattttgttggtatgctgtttcttggtctccagctgttggtcttgctgagagtagatgatttttatccgtgtatactttctttgacagtgcctgatgcaaaggcagtagtacacttggaattaccaaaaaaaaaaaaaaaaaaaatcacgtggggctcatgtggcaaatcagggttgctgccagagccaaggattagtcagtcactcattgaatttcaggatatttgcattctgaaattcacaagaagcatactttccattcctgcatttcagtagtactaggagattgtgccagcatttaaaatgcagtggaacctgacagcctttctttctttttttatgttagcttgttagatgcatggagtaagatgacaagctcattcataactgctttttctgccaggtcactttgccaagaaatcttattatggattctggggaagctggaaaggaagaaggcaattgccagcctgaaaggatttgcagggttggacaaagctgtgccctctctccattctctgtgtcagtttagagttgccactcaaggtggcattatgattaccatcaaagaggccattaggtgagtccacccatccgttactgttctcttcagatttagttccgcccaaaaggccattcagtgattcaaccactaaggggcgctgatagaaaagaaaccagaaactcaagtggctcaggtgcctgctatttatattctctaaatgaaacgtgagccttaaataatcctccaggttttttcctaagatgcctgctaatagttggtgcaatttactggagcctcacagctctgcatcacaacaagcccacttactccaccatctttgccagttaatcagagtaaagggcagacacatgttcacccttaacaccataataatccaattatctttctgactctcaaaatggtatatgtgtgtgtttatagtcagacttattcctgagggaaattgtctaatagctatcttttatggtaattttatgatggaaatttgtttctcatagggattgattagaaagtgcttaataaatattagtggaatgga

SEQ ID NO: 10212 - DNA, 1236 bp, Homo sapiens
cacccctaaaaaggttgctgagtatggggctgggctcagattatgataacactgttccaggctacacatttagaaggcgctgctgtggataggagagaggatcagcaagtcctacgaaggggggactcagggtcagggtcttccctatttctgttgattaggaaactcagccatgagcttagatctaatattgatcatgtccaggatgctctgaaaatgtttccttgtggaaactgctcccatcactggcagttccacagagggaaattatacaggaatggagaactgcagcaaaggcaggaggcattgcctggatcatagaacgtcagtgctgggagtgaccttagagatcgtatcaggctgggactagacaaacacaggagtctcaactaccaggcccatcttcgttccactcactatgctgactctccaaacaataggcagcccttgctgggagagctttagagatggttttcagcatctctgcgttcatcccatcacagggtgactggtttatttgccttttgatcgtaaacagtaatgaatcctttctttttgttttcaaccccaggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggtgagttttcttgttccatccacctggaaaagggtggaggatcagtgtgactttgaaaccaaaatgtgtgtacctgggggcttgttacactagtgtggtgagggtagtttgagggctgggatgtacccatttaggaatttaggaaatattccgatgtctactatgagactgaaagcaacaatgtcctttttcttaaacctgcttagtctctcgccaggtgcggtggctcctgcctgtaatcccagcactttgggaggccgaggcaggtggatcacctgaggtcaggagttcaagaccagcctggtccacatggtgaaaccctgtctctactaaaaatacaaaaattagctgggcgtggtggtgtacgcctgtaatcccactactcgggaggttaagtcaggagaatcgcttgaacctgggaggcagaggttgtggtgagtcgagatcgcgccactgtgctccagcctgggcgacaaaatgagattccatctcaaaaataacaacaacaaaaaaaactgcttagt

SEQ ID NO: 10213 - DNA, 1577 bp, Homo sapiens
cacttgggtcttcagggtcccttccgagggcatgtgttcagcactcccgcgttcagcctgaggggtgtacagttaagagaagacagttacagatctcattaatctacatttttcactgtcctctagcattgaaagaaggatgtctacctggtgaaagtatattttaacatgactgatggaatttcactaattgcccactctcttggaacttgaggagaagcggttggccacccatatgtcacctagctctatattctttcaggctgagattcttcttcaggaaaatgaggagcagaactggccacccttggctgctcaagaggcatttcagagtaggagatgcagttggaggtggggaggggaaggaaatagttatcaaataatgcaaaatggaataaagttatcttggatggaaagaacagggctaaatctggtcctctggtgtcgagatggaaaactgtggagttgaagaggctctgatgcccagaaaggacaatcaagctggttgactcttccagagaagaagggtaagccctgtatttatcctcccaggccattcttcttcactcctgctgctgtttgcagagagttgccctgattatcaggagaaaagaaccacgagcatccagagagtttacatcctgccttctgtcctctgctccttcagaaagatgaatgcctagacaatgggttcacactgaatgcaggctggaaagaatgcatgctggtggcctaatgccagggctgttgaaacaatttcagatatagcactgtggtctccactttatttctttatatgttttggccgctgcattttgattgcagctaaaagagataacagaaaggagatactggctggctgcttcatattagccctctctgttgtcaacaccttgatgaggccaacccagagatgcttgatcagtcctcagctttgcagggctaggtacagaattttatcacaggattttatcacgctctctggggtgactagatccacaggaaccaaaacgcagtttccaaaagctcgagtgactgaaggatctatacacaaacatggctatttgctagttaacaacaggatatttctctctggccagatcacagacatggttctgagtcagatcttccttggtggcatccctttaaagaggccatcttatgaacaggatcacaagtgagcttagtgagcagagagttagaacaaatctagctaggtgtgtttaaggaatatttccattcagctagtgtagctggattaatttctattctccaaatcaaggatgtctagaaaatgggcattgtggctttcaaatctaagaagaatctcctttgggccagctggatgtacaataaaaatgcttgtttcttggccttcctttaactagactccacgcaacccacttcagaccagcagatcgaatgtgttgcacaatccattttacttacaacttcatttgcattaaccgcattccagttctgaggacagatcctgattgaccaccttgattagtctaagacactatctagtccaaaatcctcgagtgcctcatgaagcatcctagtacctttatctc

SEQ ID NO: 10214 - DNA, 1234 bp, Homo sapiens
ttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaacca

SEQ ID NO: 10215 - DNA, 1572 bp, Homo sapiens
tctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggctgctggtgtcactgtgttttgttacctgtttcatagggaaggaagtttcctctgcttttcattgtttcagcttggctacagtcttacatcatgtcggctaaaatgcttttgctccaagaggaagcaagctttggtttttagtcttagcaagggcccattcatctgccagttagttatttcaccaaagaccctcta

SEQ ID NO: 10216 - DNA, 1244 bp, Homo sapiens
gtttgttattcaaggcctagctaatctgcgatgctctctgcttgttctccccctacctctgcagtagcagggaaatttaattttggggaatctggaaagctcacatttctgaaagtggaaattctcctatgtggggctagaaagtaaaaagggcacatgggtgggtggtccagtgtggctgctcaacaatggcagagccagaccagggattggaggtgccagcatagcctgccaagagcagctttaggaggcgcctgagtgttatggccttgccccggaacctcaggaatctcgttcttgttctgccaaagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacc

SEQ ID NO: 10217 - DNA, 1144 bp, Homo sapiens
tgttctgaattcctgttcagaacaggagactgtccaggaaatggagaatgcactgaaaatatttcggcatttttctcaagcacatggtcacagtgcttaacgattgattttggttgtcaggaagtaggctctgtctccttccctgccttgatcttcctagaatataccgtgtacctatgtgaacaccttattgcttctctaaaaccacctgtattttactgtcacttgtacccatccaggaaaatatactacatcatcttcaaaagcatatttgcaagagccccttctctgtgtgcattattgagcctttttttgattcgtggctaaaatgtaccattccttaaattgtcaaaattatgggtcagaatgctgattttcttatctcactgtctcaaaaaacttagttcatctcaatagaacttggggtctttaaagcacctcagcagatgttatatttggtctttgcaatagtttcataggacataatctaggtgtcatagtcacaaagtgacttgttcttgactacacagtaaagaggtccacacttacaggcaggagagctaaatttaggccttctgattttaaattgttatccttcttcaagaaaccttataaaaggatttttaaagtgcttttagttctgttgagagtagtggtggggcctcttttggaaatgtttgggttctgagcttgggtattaccccttttccagtggtcccacaatctgtgctggtgcagaaggtctgactcaattcaaggatgctctcttgattccatattgcccttctgaccagctattgcatatactccatgcctgcctgatgccttgattctttttcgttctcattaatactttttttcctttgggaaggcagaattgtgtagtgattatgagtgtagatagtcagatggcccagatttctactctgtcacatagcagctgtgtgtgtccaacatacaagcaagtgacttcatctgtgtgtgcctcagtagcctgatctgcaaaataggaataaatacctatatcatagacttgtgatgatggttgaatgagaaaccaccaatatatatgcacagtaaaaattccacagtaaaaattcaaaacatgttagctgctacttatatttgaatttaaaaagtctag

SEQ ID NO: 10218 - DNA, 1212 bp, Homo sapiens
tttcgtcaagcaggtctaagcataaaatgccttgatagctacgaaaacttttgggttgggtgcagtggctcacgcctataatcccaggactttgggaggccaaggctcactgcagcctccgcctcccaggctcaaacaatcctcccccgtcagcctccgtagtagctgggactataagtgtgtgccaccacacccggctactttttatattttttgtagagacagtgtctcactctgtcgtccaggctggaatgcagttcaaaccttttctgctgaaaatgttttgccgaactagtcctagtaaaagaaacaaatttaactgtataaaagtaattagaatttgagctgaaaaaatgaaaatgtcattaggcatgatctgatagcacaaaaccccacactagttatttatggggaagttgtttttaccatgttgcctgtgaccactcagtaccggtacctgatgaatttgtggtaatgttgagaagttatggtgtttctgcagtttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttagtaagcaactattggtaattcaaaccaaaatttctctcgtgcctgctcagactttcttccctgtgctcataggagagtaacgatatattatggcatgtggcaaccccaactataagattggaattgatagtgaagattttaaaaatccccagcattctttttgctactagtctggaccttgttgattcatttatgaaatgagaggattacatcagttcaacatttcccaaactgtgttctgtggaatttggagatgtagaggtttttttgttttggtttgttttgtgttttatggtaaatttcatttcacaaatacagcatatttaatcctgctgtaaattcacaatgcacatcggtacatgaagagttctgagagtcccttcagcaagttaacctgtgcacttgtgtttcagcccagtgtttctcaaaaatatgaccacacactgagccccttcccataattaccattagagtgggtgcttccagatctttaattctgtgatgagtctgatta

SEQ ID NO: 10219 - DNA, 1238 bp, Homo sapiens
ttttgcatcttcgtttattaagttgtctgtatatggtagtgaggtagtgatgcttagtgtcctttctccacagaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttattgcttaccaaatgtgcctttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaatt

SEQ ID NO: 10220 - DNA, 1211 bp, Homo sapiens
ggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccata

SEQ ID NO: 10221 - DNA, 1159 bp, Homo sapiens
tgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttat

SEQ ID NO: 10222 - DNA, 1164 bp, Homo sapiens
ggtgaaaaacatctttgtgcctatgcttgatttgcaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaagtatgaagaccttctttgtagaaattttggggctggttggtggtcctggttgggcctggtattacttccgtgaatgaagtaactttcagctaagttactcaccaccaaggcttgctcagactgctagaacttgacgcaggagtggccagtgacgacgtagccatccctgccggttctgaagccccgcatgtgggcttccaagccttgcactagggcatgagtgggaatggaaaggtttcagagcctcctactcatcgctgctttcatttttagcaaacatctgagtgtcttgacttctaaacattagtcttgtgtgttaaaagaaatttgtttgcattgggccacattatactttgacccttaaaaagagactgatgaatatgtataattttgcacccttctgagcatttgagacttggcaagttcagtgaatacttactaatctcccatgtcctgctaggtactgtggggcagtggctagaatactttaattttgctccccattgtgattctcatcctggctttgagttttgcttccctttgtgtcctgtggtggatcctccctccaggcagactggcctgcttgctctctggaacatgttgtttgtttctaccactgtacttttgcttcctctcattccccacagtggaccgtcatcccttcatcattgcttgtccaaatcccatttgtcctttaaagggaagaaaagccgttgttgatgaagtgctttctg

SEQ ID NO: 10223 - DNA, 1166 bp, Homo sapiens
attataattaaatttaattaattaatttatttgtttttgagacggactctcactgtgtctcccaggctggagtgcagtggcgcggtctcagctcattacaacctctgcctcccgggttcaagcaattcttctgcctcagcctcccgagtacctgggattacaggtacccgccaccacacctggctaattttttgtgtttttaatagagacagggtttccccatgttggtcaggctggtctcaaactcctgacctcaggtgatcctcctggctcagcctcccaaatgctgggattacagaagcgagccactgtgcctggcctaacattataattttatagaaagaatgctctctgccaagagtggttccaagtggttagttctagggaaggtgagaaataagatgaggcagaatttaacctctatcactgcccaggtgaggtgacctgatcaaggaatctactttcatttatttattcattttgcccgggggcatggcatgcactcacatgtgtgttcgcgcttgtgagcagtgtgtgtgctcactcccagctcccattatgttccaggcaccatgctgtgttctaaaacagccatgaatgggacaggcgtggtctctgttcccgatggagtttatctagtctgatggagaagaaagatattaaataaataattgcaattgtgatacataaatatcatgaaggtacatatggcattgtgagaatcagtgcagtgggaccccgtctggggggataaggatgtcaagttatgtttggatctgcagacctgaacttcagaccctgccaaggttacaccattcctggcagccagctggtttgcctctcttaggtgacagccttttcttatcaggctcattctaacccaaatgcaaatacctatagacctgcaccgtttcctcctgttcaccccccaggtctgttatctttctctgccctgcagactgttttttaggaagtagtttttgtcttctctaaaattttaacctccatgttttattttgatgaggtaatgtgtttggctagaggacccccttttcatcactaggcctaattttgcacttcctcaatcttaatgtttctggatttcattttccatgtcaggtgatctctagtatatctccattgttatatttttattacatcactat

SEQ ID NO: 10224 - DNA, 3101 bp, Homo sapiens
tttcgtgtcttgggggtggaaaggtagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatccatccaaaaggaccttttttttaggaagtagacttgaattcacaaaacagtcttgacatgggtagctggtgaaaaaccctctggagagcaagtggagccagtccccattggctgacagtgccacctggagctggtctctggggtgttcggttgtttattcctgaggaagactagctgctgctgctgctgctgctgcaaactgtactgtacacatcatggctgctggacacgaaggaggaggtgagagaagtttcatgctaccgaaatagagggtgttggtaccactgcccctggcctgagagccagggtttaaacctgcctcagtagagtctagtttgaaatgacaccaaaattcctcagcccctactcagcaattggttttggtttccaaatgacttctgcatttgtaaagataacagagtggtggggtcaaagtttatcttgtgtttagatctcttcaagactgcttaagcaaaaacaaaaatcccttggaacctatcgtttgagcctgtaaagttgttttagcagttgtcataaatgcatatgttgtgaaatcagaacactgtcgagtttatactcatttagctgcaatgtgggacaatgaaaaatgctttacaggcctggagtatcattacttatggtatctcctgctttaaaatctcaagcgatatctatctggttaaattccattttaggagattgagatgcagaacgttaatgttcattacctcctcctaccccaagagaaatggattcagacatgtcttgtctcaacaagaaattgatttttttttaaactatcttattctgttgccaaatatcacagaagtaatgaggagtttagttacatttggctgttgtgctctgaaagagccaggtttggaatttgtgggggtgatctaggaagaaggttccaaagaagcagaggcatttgtcaagttacctaccctatatccagcatcctcctcatgagcttcagtagctgctctttgcccacgcttgtatcctacgtttgctatttgggcaaaccattacttcagttatttaacttccctttttttttaacttcacctttgactatgaacaagtaacggtaacattccttttgtgtattcaataatgcagttagtttacctttttcagaatattttgaacaaagatctttgtctctttctgctggaatgcgcacacagtgaacgtttgttagaactacacacaataaagacactgttttccttttcttgccccgactacacttattatttttaatttaaaaaggtgttttttaagtagaagtgttggttttgtaatcctcaggtgttctggaagaaaaggatttcagaagcatgacagtctcccgtgtctgtgctaatggtgtgtttagcataacgtggtgg

SEQ ID NO: 10225 - DNA, 1148 bp, Homo sapiens
aaatctatggattgtaacataagtaaaataatgctatttgggcatttttaaaaattccatttcttaggccttatattgcttgaagcatttatattctaaaacataaccaaattctgactattcattttggggaaaaacaatcagttcacaaatcacattttcaatgggactgctagccagcataggtgaaaacatgtatagtgtatttactcttgaattgtacactgcagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatgggttggtattcacattttttaaaattctatcatcattatgcaaaacaaacaaacaaaaaaaattcccaatttttcctaattgctgagctcaagtttgcatataaagcaacagtgctaattttatcattgaaatacatgaaaattttaacttaaaattaccaacttttactagatagaaaataaaataatcatagattctagcaatagatatcttattatcagtatagttaggtagtagaaaatgaaaataatctgttctgaaataaatttcaaatgaatttatattttaaaaggacttttactcagccaggtgcggtggctcacacctgtaatcccagcactttgggaggccgaggcggg

SEQ ID NO: 10226 - DNA, 1253 bp, Homo sapiens
ctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgtt

SEQ ID NO: 10227 - DNA, 1208 bp, Homo sapiens
gtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagc

SEQ ID NO: 10228 - DNA, 2445 bp, Homo sapiens
gtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggt

SEQ ID NO: 10229 - DNA, 1427 bp, Homo sapiens
atgccggatggaactttgggattgaccccaccaacaactgaacgctttggtcaggctgctacaatggaaggaattggggcaattggtgaaactcctcctgcattcaaccatgcagctcctggagctgaatttgctccaaacaaacgtcgccgatactaataagttgcagtgtctagtttctcaaaacccttaaaagaaggaccctttttggaccagccagaattctaccctggaaaagtgttagggattccttccaatagttagatctaccctgcctgtactactctagggagtatgctggaggcagaggacaagggaggggtggtattaaacaagtcaattctatgtagtatattatttaatcagttctgtgtggtgcattcctgaagtctcaaatgtgattgttgagggcctggggaaaccatggcaaagtagatccagttagagcccattaatcttgatcattctgtttttttggtttgtttgttgtttttttttttttttttttttgtccatcttgtttcatttgcttgccctgcccccgagatggagtcttactctgtcgcccaggctggagtgtagtggcacgatctcggctcactgcaatctctgcctctcgggttcaagcttgtccaggctgatcttgaactcctgacctcgtgatcccctgcctcagcctcccaaaatgctgggattacaggggtgagccaccgtgcccaacctcacttgctttcttatccttacactcccccagtcccagagaaactgccacatacaccacaaaaaccaaacatcccccaatgaccttagccgcattgctccattcactcccaggtgagaattcaggtaaacgtccacaaaggtcacaggcaacgtacatacggttctattatatcccatatattaccccttcatgtcctaaagaagacattttctcttagagattttcattttagtatatctttaaaaaaaaatcttgtgttaacttgcctccatctttttcttgggtgaggacacccaggaatgacccttttgtgtctatgatactgctgttcacagcttttcttgataggcctagtacaatcttgggaacagggttactgtatactgaaggtctgacagtagctcttagactcgcctatcttaggtagtcatgctgtgccttttttttccattggtgtattgtatttgatttgtctctgatatatttggagtttttctgagaactggagcagtaatgcagcatcgacctattaaaatacattttaagcctttaaaaaaaaacagtacctatctcataggggtgctgtgataacgaaattaggtaatctgtattgattgacttttaaccataagaatatatacaggttttaaatttatttatttattgaagagatgggggtctctctatgttgcccaggctggtt

SEQ ID NO: 10230 - DNA, 1194 bp, Homo sapiens
accatactccaagaaagcatcatcaacatcaccaccagcagcaacagctgcagccgccaccaccgccaatacctgcaaatgggcaacaggccagcagccaaaatgaaggctttgactatttggcctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggattaaggatttggctttatccgcttggaaacacgaaccctagcggagattgcgaaagtggagctggacaatatgccactctgtggaaagcagctgcgtgtgcgcttttcctgccatagtgcatcccttacagttcgaaaccttcctcagtatgtgtccaacgaagtgctggaagaagccttttctgtgtttggccaggtagagagggctgtagtcattgtggatgatcgaggaaggccctcaggaaaaggcattgttgagttctcagggaagccagctgctgggaaagctctggacagacgcagtgaaggctccttcctgctaaccacatttcctcgtcctgtgactatggagcccatggaccagttagatgatgaagggggacttccagagaagctggttataaaaaaccagcaatttcacaaggaacgagagcaaccacccagatttgcacagcctggctcctttgagtatgaatatgccatgcgctggaaggcactcattgagatggagaagcagcagcaggaccaagtggaccgcaacatcaaagaggctcgtgagaagccagagatggagatggaggctgcacgccataagcaccaggtcatgctaatgagacagaatttgatgaggcgccaagaagaacttcggaggatggaagagctgcacaaccaagaggtgcaaaaacgaaagcaactggagctcaggcaggaggaagagcgcaggcgccctgaagaagagatgcggcggcagcaagaagaaatgatgcagccacagcaggaaggattcaagggaaccttccctgatgtgagagagcaggagatttggatgggtcagatggctatgggaggtgctatgggcataaacagcagaggtgccttgacccctgctcctgtgccagctggtaccccagctcctccagg

SEQ ID NO: 10231 - DNA, 1176 bp, Homo sapiens
tatttcaagacaatacattttcaggattgaaaattttaaaaaacaacatcatgttttaacacaaataagaaaagaataagcccctgcaatccctcatctagatggagatgcctcctgttgacagttccttagggtctcctcggtttctatgggcagggggatattacttgcaactaatttcttcgtctgtacgccatcaatatccctatgcttttctcacagtcctgcaagtataaacaaactaatacatcagtaatgtggaaattatggtgctgacccagtgatatgaaatgtttagaaagagtgcagcttcccctccagcctgatacaacagtgatttcattagacatattccttcccactcttttttccatgccacgaggcaaaatgtgaagatgtggagaaagcattcccagagaagccagcaaaggtgaaatgaaagcttctaatttagagaatcttaacttggggtgcattctctttagcccatccatgttgccttttgtaccccacagtggagaacatgcagctgaccctgaacctgcagacggagaacaaaggcagcgttgtctcaggcggagagctgacaattttcctggacgggccaactgttgatctgggaaatgtgcctaatggcagtgccctgacagatggtgagtgccgccctgctcctcaggactgtgccgggacagggtggggctgggcgggggccaggaggtgctgagagcttggttcttactaggccatcttggtttgattcccactcagcctggcccatagctagcccggactcttcttagctccgtggatcagtatcacaacatgaattttcaagggtcacagtaaatgtccagtctttgtaaatatgtaattgtttggtttgatagcagagaaaaacatctttcatcccatgtggactttggaaaatgaaatatctttatcaaatgtgactttggcccattattttccttcccaatacagttacactttttggggaggttgaaggtgtttttatgagaggcattggttgggaagggtacgctgtgttcttctagagatacacactagcaaaatacagacagagcagggaatttggagagtgtcccttgctctgtcccgaatgttggtagtttgtttcttttgatctagtctgaaattagtcacctttggatctag

SEQ ID NO: 10232 - DNA, 1164 bp, Homo sapiens
gatgcctggaaacatgcaggtttggagctggatcttctcgatgcagacacttctgctctcgggtagttatttaagaggttgtgtcaaccctgttatacctgcagggtaccacttagtcaatgagcactgcagtccagtgtgccagaagggccttctggtccttctgattggagagatcatttagtgaagcttccacacatttgttgatgttcagcttggggatcccttacgcagatagctgccccacatggctccctggaccaaagaaagatcattagtatctcagagattggcagcaactccaatgcgagagagtaaaactctgaagaccctgcgtcgtcagtaggcaggggaaaatgcgtcagattaaacaagaatctgtactgctgtttagtagccagtggcatagaagccggggacttctagtgtatttcaggctctgtagaggcaggtgatgtagcccagtcaagtgggttttcatgccagttctgctgagtgatggtcaccaggtaagcacagctgatggagacttgaaaacagctctcgaatgctaagtgtggaaatatttgagatagaaatggaggagccgtggtcagagtcgatactgttaatgaacgatcagaaaaaaacccacaaaactgtcatagtctagaattaagaggaagaacattctggctaaaggccagggctccttctgaatctcagatccttggggatctgtgttggctgccccagggctgtggctggggccggctccccagggctcaccgagaatgaacaggaagaacagccagaccaagtgagagtgatcggcagcttgctaacccagcctgctggtgtccctctctgctgccccaggagagaccccgcatcttccccacacactgctgtgggactcaggacacctcgggttcagatccacatctgccctcggcagccctgaccctgggcctgtggctgaatatgtctgagtccctttgtcctaaaatgaggtcgagccaggtgttcctggggtctttcccagcccccaactgaaactgaatgccgcgaggcagccagccggccttgggaggcctccacacagcagcagtgccagaaatgacgacacaggcctcaagcccgctggacagatccccctggccctgtggttagccttggctttgg

SEQ ID NO: 10233 - DNA, 1308 bp, Homo sapiens
cttcatagcctcgagtctggcagcttttgcgtggccctggggtgttgggttggagagatggggctgtgatgggcatctgatctaccgggttttacatatgaagcacttctgttccagtagtccaagagctactgccccaagtgtcccccgcaaccaatttccagctgtcctggcccctcccttaacaccccatggtccaggcacctgcaatgtgaaggcctgactggcagcccctgagccctagccagtgtggtgcaagccctgtggccctgctgcaggcaggcatggtggggctatcagagccctggcctcctagggctgactgtcgtgcttccccactctcaatagcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggc

SEQ ID NO: 10234 - DNA, 1152 bp, Homo sapiens
taccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttca

SEQ ID NO: 10235 - DNA, 3102 bp, Homo sapiens
gagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcac

SEQ ID NO: 10236 - DNA, 1327 bp, Homo sapiens
acagcctttctgcccaccggttggttacctttgccagtaccccttacccaggccttcttattggtgaagacatctggttgatacctggctttgccactctgtcctgtcctggcagtggccatggccgccccctgtaccagccgtaaagtctgtctcggcctccagcagtatcacccagggcaaggagtgggtgatggctcctccatcctttctttccctgcattcctccctcaatcccatcttctgtgctgactcccccttcccttcctgtcttctagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctggctgctgtggtgttcacctagtccagccccagaacccaaaattttgggaacagcccctagggctgcctcaaacgtctgtggaggtggaggccaaataggtggggtgacttggagcaaggcgttcataattcagtagatgaggggtggaggtagttggaagcagagaagcctttcttggagctgctctcccccctcccttccagcaagatggatggatccggctaccctgcacaactgggaccgggccgttctccctccgggcctccaggggcgctgtagtgcctcccgccgctctctcgacagcccatgcgcagccgcgcgtctttaaacaacggaagaaccagtggatgcggcagggcgttgggcggaaggggttcgcacgccaagaaccgccatgcctggggatcaccgccgcatccgcggccctgaagaatcgc

SEQ ID NO: 10237 - DNA, 1327 bp, Homo sapiens; identical to SEQ ID NO: 10236

SEQ ID NO: 10238 - DNA, 1113 bp, Homo sapiens
ttttttgagaccgagtcttgctttgtcacccaggctggagtggagtggcacaatctcggctcactgcaagctccgcctcctgggttcacgccattcttctgcctcagcctcctgagtagctgggactacaggtgcccgccaccacacccggctaatgttttgtatttttggtagagacagggtttcagcgtgttagccaggatggtctcgatctcttgaccccgtgatccgcctgcctcgacctcccaaagtgctgggattatagggggagccaccgcgcccggccgcgaagccctttcatattgtctaatgagtttgcttccaaaatacaattggacaattaggagctaagaagagtttgcgaaagagaatccagcaaaagtcagccaagaaggagtgaaaaggtcattgaccccactgtcccctttctatgcatttcccttgagcagtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagatgtgagccaacagttcttccttgttagccgaggagggccaggcgtggagccggggagctgcttttgccccacagtgctccaggccttgggagcagacctgacacacctttgggttgggttccatggtatttctgaagccgagggagctgttgcttgtacctgttgctttcctggccatcgggtaccctcgtaggagtatttttgcagccagggtacaagtttcctacaagctttgcacattaaaaaggagaggcagctctctgaaggggagatgtccttgtagaaaactcagcctcgagctctgccgctgctgaatgagttactttgtctccctaggcttcaggttccttatggaggcttttagatactcaaagatgcggctgggtgtggtggctcatgactataatcctagcactttgggaggccaaggcgggtggatcgcctgaggtcaggagttcaagaccagcctggccaacatggtgaaac

SEQ ID NO: 10239 - DNA, 1103 bp, Homo sapiens
tctcctgacctcctgatccgcccgcctcggcctcccaaagtgctgggattacaggcgtgagccacagcgcctggccaaattttttgtatttttcctagagacggggtttcaccatgttagtcaggatggtctcaatctcctgacctcatgatccgcccgcctcggcctctcaaagtgctgggattacaggcgcgagccacggtgcccagcccaggtgaggtttaaaaaacaaaacaaaacaaaacagaattgtatcaggacatccattgtgcttcccccaggttaactgaaaaagatgtgctggattttctgatgggcacacagggccgatactgatagccttgtgtctttaattccttctgccagtcccagcatccttttggagggcttggcatggaaaaggggctgtctgttttttttgacacacctcctttgtgctgtgtaggagacactgcttggctcctctatgacacctatgggtttccagtggatctgactggactgattgctgaagagaagggcctggtggtagacatggatggctttgaagaggagaggaaactggcccaggtaaagaacttggagagtgaacaggaaacccaacaccttccaacccagcaccacttggctgcagactgagcatgagtttccttccattaaagtctttgaagtgctttttcccctagatcagtggttctcaagtgggggcgagtctgccttccagggagtaattggcgataatgtctgaagacatttttgattttcacaactaggggcagatcctgctgtcacgtacttggtagaggccagggtgcccctcagcatcccacactgcaagagaagtttccacaacagagaatgatctggccccaaatgtcagtagtgccaggattgaaaaaccctgttctggcagtttatgctgggcatagtttagcaagttccagtcctttggagtcccttttctcctactttacggtaacttatgcttgtttctcttgctgacagctgaaatcacagggcaagggagctggtggggaagacctcattatgctggacatttacgctatcgaagagctccgggcacggggtctggaggtcacaga

SEQ ID NO: 10240 - DNA, 1068 bp, Homo sapiens
caggacctgtatgccattatgagggtttcaacttgtactctgaatgaaacgaggaattattggaaggtctttgggcagagaagtaatgtgagctgactcacattttaagaatcagtaggccaactgcagtgactcacacctataatcccagcactttgggaggctgaggcaagaggatcacttgagcccaggaggttgaggctgcagtgagccaagattgtgccactgcactccagcctggtcaacagagtgagacctaatctcaaaaaaaaaaaaaaaaaaaaaaaaaagaagaagatgtggagtgcttcaaatcccaccagaaaatcttatttctatagtgccctgttcttgtgaagctagcatatgtaactctgctacataatccaaggtctcctataaatgaatttttaatactcatttttttaaactttgttaactaaaaggttgagatttaagctcctaactagtttgtttcttgcgcagcccacagaacttaattgcccaatctcagtctggtactggtaaaacagctgccttcgtgctggccatgcttagccaagtagaacctgcaaacaaatacccccaggtaaggatttatgaatttaggttttctactaatgcatagatagaaggggatttccatttgatggattaaaagacaagctatgggctgggtgcagtggctcatgcctgtaatcccagcactttgggaggccgaggtgggcggatcacctgaggtcaggagttctagaccagcctggccaacatggtgaaaccctgtctctactaaaaataaaaaattagctgggcctggtggcatgtgcctgtaatcccagctacttgggaaactgaggcaagagaatcatttgaacccgggaggcggaggttgcagtgagctgagatcgcaccattgcactccagcctgggcaaaaagaacgaaactctgtctcaaaaaaataaaataaaagccaagctatgcattactttttacacaaactgaaactccttaaattgagcacaaataatacgggatatcttccaatggcaataaaaatcctgtttcct

SEQ ID NO: 10241 - DNA, 2452 bp, Homo sapiens
gtagagacctgtgtatctttcccccagataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaagtttcatcttttaatttggccagtgtttccttcatgctaatctagatgctgtggctgattacttgcccaggatctcctgtggcagcctctgcttgttctctggcttggagtggatggggcagcctccagctcctgtggaagtaatggaatagtggtggaaagggaacacagagagggaggcttccagtaagataggtgtgtaagcccagccatcatgtttggaatggcatgaggcagcagaggaggcctgagagctgctgctttggacttgggggtgggacagctcatctgagtattgccagccccctgtcctagtgcccacagcagaagggaatttgttaaataagcatggaccaaaatgccaacctctcggttgtgtatatgggtttgtgtcacaggactgtgacctgttctcggtgggtgcagtctgtgtagagtgcacatctgattattggtgggtcctgtgcctgtgcttaagcaagtcctgtggagaagtcatcatggagaattagtggtggccctagcgtgccacaaaacctggtctcatgagcatttgcaacatcccttttacatccttaatatccccttaccccacagtagccccaaacaaatgtgatctgaggtttagatcctcagtgaaaattgtggtttcaagtcttcatggccagcctcaaggcagttctagatgtgatcagcagtagtcacaaattcttgttttgtctccacacccagaaggcaagttttgtcagagctggggaataatttcagatatttgacatcttgattataaagggcttctgaacatctgtgtttactgcctttggaatacaaacaggtgcaactgagggactagctacactaccaccatttatctgtccaaggcaagagtatcaccaaggcctttgctccagccttacttggcatctttgcgcaagatagtcagagcaaacaatagtaatggacacttctcacacctggccaaggctgttggtacccacgaaatgacagcaaagatgagaggaaactgaattgcaagagcaatatgaaaccccaaccaagaggagtactctgcagttctttggctttggtatagagtggccactttctctaggacctggaagaagagtttgatggctaagaacgattgtgatcctaggtcttctttgtacgcatctccgtatttaggccagatctgcctcctgggaagggaaggggccaatgtcagcctccaggtgatttctttaatctgacattacaaagagaccaacagactgccaattctaccacattcccctggtgggtactcgactatgtagttttctctatgcttctggtcaactctgacacatcttggaattcttgtaataagaaaagaaatttttatacttttttctccttccctgagtcctgtggaccaaccctgaaatactaaaaacaagggcaataattaaagaagtatagactctttagtaggccacaggcagagcagactcccaccttctcaagcacatacaacctctctactggtgtagccccaagtgtgagaaggaaagtgggaagcggggtgctgcagactctttgacagcaggaggaatgggaatctggtagaagtataggtcaacagttctttttttttttttttggaaacggagtctcactctgttgcccaggctggagtgccgtggcacgacctcggctcactgtaacctctgcctcccaggttcaagcgattctcctgcctcggcctcctaggactacaggtgcacgccaccgcacccagctaatttttgtatttttagtagagatgggggtttcaccatgttggccaggctggtcttgaactcctgacctcaagtgatccacccaccttggcctcccaaagtgccaggattacaggcgtgagccaccgcgcccagccaacagttattaatcaggggtcttggacctctaagaattcactggatgggtttcatggagtctacgaagtatatatacagtagtttgagtttaaatgtattttcctggctgggtgcagtggctcatgcctgtaataccagcactttggtaggcctaggtgggcggatcacctgagatcgggagttcgagaccagcctgac

SEQ ID NO: 10242 - DNA, 1438 bp, Homo sapiens
tactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaaggcgtgtgtgtatataaagtgagagtgctctctatcccttctcttctgggatcctgattcctggcagcttggtgaatattctaccatattgccttttatttgcataaacccatttttcttttacaaaaacaggaacattctgttcacactactatgcaacctgctttcactgatcagcatgtgttagacatgttgacatgtccaatacacacacatcttccttgccctggaaacaccatccaccttcctttctgcgtgtagctgtcccggcatttatctcctggttcctctagtgacaggcatgggggatttctagtacatggctgttatccacagtaccacaatgaacattttttttttctttttttgagacagagtgtcactctggcccggagtacagaggcgtgatctcggcccactgcaacctctgcctcccagcttcaagcagttctcttgcctcagcctcccaagtagctgggattacaggcacatgccagcatgcccagctaatctttatattttctgtagagatggggttttgccatgttggccaggctggtctcgaactgacctcaagtggtctgcctacctctgtcggcctcccaaagtgctaggattataggtgggtgccatcacgcctggccgaacatttttttttttttttttttgagacggagtctcactctgtcgcccaggctggaattccgtggcgtgatctcagctcactgcaacctccacctcctgggttcaagcgattctcctgcctcagcctcctgagtagctgggattacaggcacatgccac

SEQ ID NO: 10243 - DNA, 1227 bp, Homo sapiens
aaaaatacgaaaattagctgggtgcggtggcatgtgcctgtaatcccagctactcaggaggctgaggcaggagaatcgcttgaacccaggaggtggaggttgcagtgagctgagatcacgccacggaattccagcctgggcgacagagtgagactccgtctcaaaaaaaaaaaaaaaaaaatgttcggccaggcgtgatggcacccacctataatcctagcactttgggaggccgacagaggtaggcagaccacttgaggtcagttcgagaccagcctggccaacatggcaaaaccccatctctacagaaaatataaagattagctgggcatgctggcatgtgcctgtaatcccagctacttgggaggctgaggcaagagaactgcttgaagctgggaggcagaggttgcagtgggccgagatcacgcctctgtactccgggccagagtgacactctgtctcaaaaaaagaaaaaaaaaatgttcattgtggtactgtggataacagccatgtactagaaatcccccatgcctgtcactagaggaaccaggagataaatgccgggacagctacacgcagaaaggaaggtggatggtgtttccagggcaaggaagatgtgtgtgtattggacatgtcaacatgtctaacacatgctgatcagtgaaagcaggttgcatagtagtgtgaacagaatgttcctgtttttgtaaaagaaaaatgggtttatgcaaataaaaggcaatatggtagaatattcaccaagctgccaggaatcaggatcccagaagagaagggatagagagcactctcactttatatacacacacgcctttttaaaatgagtatatatttgtctaataagcagaaaaatacaaataaaaacaaatcattagtagagcgtttctcataattactttaaaatgtcttagcataatgaatggtgcatacgctacaatttatccatccttatttatttattgagtcggggtctcgctctgttacccaggctggagtgcagtggcgccatttcagctcacagcagcctctacccaggctcaagcgatcctcctacctcagcctcccgagtagctgggactacaggcgtgcgccaccaggcccggctatatttttttctatttttggtagagacggggtttcatcatgttggccaggctggtcccgaacgcctgagctcaaccgatccgcccgcctcagcctcccaacgtg

SEQ ID NO: 10244 - DNA, 1184 bp, Homo sapiens
gcacaagctccagatattcggcctctgggaacagaagcctactgtctgtcctctccagggtctcacatttaggggagagctacatctgaggacaaaattttcatcatgggaaaggccctccagccctaacaggaagcagagaggggaagggactcaacccatggctgagttccaaggaagtctgagctgggcagggtccccagtgtgtggcttcacagctccctagatgccgactatgctgggtgtggtgttggttgcttcctgcacattggtcctcaggcagtcctgggaagtgggttactcctggctccagccggcactggaatccggcttctttaccatgacactggctcagcagcacgtcttggcacttcatgcaatctccagatgggtgctgagtatcttggcccaggcacgtcactcccctctgccccacctcaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgaggtactgatggggctggggttggtaaagagacctctgggggcaagagacctcactgtggcccaccagttaaccaggggctatatctgtaagtccccctggtcctgcaggcccagtccagcctccagaaggcctgagatttgtccagagccttctaaatacttcctgtcttgtccagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtat

SEQ ID NO: 10245 - DNA, 1085 bp, Homo sapiens
gccatttgtgtatctttggagaaatgtctattcaaatcccattgcccattttttaagagttgtctttttatttttgagttctctatgtgttctgggtactagacccttgtcagaaatacgatttgcaaatattttctctcattttgtgggttgtcatctttcttcctttgatgcacaaaagttttaaattttgataaagtccagtttatctgtattttctttgttgcttgtgctataaataaaatactcactgcacttcccagatcttttccctgaattgttttgaaacaaatcctagctgtcgtacttagtgataacacctaaaaataataacaatagtatcttaatataatcaaatagcttgtgctttatgttgatgccagacattatcgtcaggcagagaactcgttaccgaaagtttctctcctctgcttcttcccagttacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccaggttggtgggcctttccagccccttccacaatagatctaaagttaaactgaggtctagtctaagaaatagctttattagtatttccatgaactcgccagtgtgtaaagcagttagaggtagaagtttgagcacaaaaaaccattaataagtcctcgggctttttttcccataatgacaaaactcacgtttaatgtaaaaatgcagatcatattcctgtacagcttgcaggggaggaaaaaatcagaccatacaagaagtgagaagtaaaagtcctccccgtaatcttctcacctgtccgctccattgagccatattgcttgtattaacaacttcttgtgactgcttctaggtgttttctctgcatttacaatcatgtatatgtttatgtgttatatctttttctttttaaaataagtggattcatatactccacagtattctgtggttgacctcttgtcatgtaacagtctacatata

SEQ ID NO: 10246 - DNA, 1112 bp, Homo sapiens
tcttgaactcctgacctaaggcaatccacccgcctcggcatcccaaagtgctgggatttcaggtgtgagccactgggcccagccggtggtgactgatttctatgagtgcttatagaagggagaggtgactgccagccaaggggataagggaataattttgttaaaggaggtggcatttgaattggtccacatgggatttggccttatgggagctggggaaagaaaggggatgctaatttagatggcctgattgattcccagtggttactgctgttctgaggatgatcaaggcatattgtacttgaaggaaaggggtatggttttgcctgcagcaactgtaccctctcagacatcctgtaacttttgcttaagactgtcatggggattgccactaagaaccagcctgtttggttcttagattcttctttcactaggtggtttcatcctttaaatacagcatacgttgtgaaccctgcctttgagaccttattttttgatgtgattgtaagcaggtagctgagttgcatgctcactggatctgtggcttccctcttctcctgtcaggtgtcagaaatggctgtttctgagctacctggtaaccccaacgctgtctggacagtgcgtcgacacattgaaggtaagcagctttttcccaatagtcaaaatgaggatctaggtgccattgacatagaaggcttgaaaggctgcgttcataatacttctgtatcatttcatttagcaccatataccagaaactttctggcccaacactgtttttgaggctcttccgttcaggatgccttcacctaccatttctttttgtgcaggtgggaaagggggaacataggttggctgttatattttagtacataaaggtttcagaatcatagagctgtcaaatgtggtattgactttatattcataaaggtactggtttcatctgtaagaggtatgatatgagggaaagttgtgctttttcattcttcttcaactatattcttttaaattgttttgaaaccacagtgaaattgaaggtggtgttctaggaattaagagatttgggaaagcttgttagtcaatcttgctagtgcttaaggaaagcagagtggaat

SEQ ID NO: 10247 - DNA, 1205 bp, Homo sapiens
ccaaccctagaatgagttagtctcacagaggcttaagtaatctctattttattcattagagcttgtgttcatttctacataagctgcttttggaagaagttaggggtctttcctagttagaaggagtatctcttcttaggaaggggttgtgtgattgacaactggcacaaataaatgaagctctagctcagtatgttcatgtatcaatattgtagtatttaaaatgtcctcatgtctccgattctcttgctttgtcctctcacttctttagcagatgtctcaagaaaatattgaggaagcagagtatatctgtaggctcttctgacccctagttttcttctggatcattttgctctgtgtgcatgtgtatgtgtgtatgtgtgtaataactacacatagaagaactgccttggaaggtttctgaagagaactcttagtgtttcatttggctttgtaattctaatgagttcttatctaaccaactcccttcttttctttttcagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtgagggttctcagagcttacctacttggcctgctttgttctttcttggccttcattgtgatgcaggctgctgtgttcatgtctcttcaccctcaccttccagcaagccttaggggtagggaacatatgatttgggcacataatatccctctctgtatttgccatttttctgttacagagccacatcactgcagctttcatctctaataaagatctttataagtgttttgttaataagctttgaacttctttgaagtggacactgcaaaacatgaactatttaaaagttgaccttgcctgaggcctactaactcttttgtctttgattcaactggtgcctcaaatgcagtggccccaggtctgattttagtgacagatctgatagatgtgagggtcattctgagtgatgaatcaaattgttaaagtcaggtttctttctgttactgactctaggtctatccagatggcattcggcacatacgagcagacaagagagtcaatgagtggaagacccctggaaagaaaacaattgtgaagtgtgcagtgaacc

SEQ ID NO: 10248 - DNA, 1179 bp, Homo sapiens
gatccactcctgatgtctatctctgagatcagctgggttagaacccagaatccatacctgctgcttctcttgtcattgcagtgtgtttcaggagtttcctgctgtggtttaaggatatgatctgagactacagaaatgtttctttggcttaagcctcaactcctttttttaagttaacaaccaagactgcataaatttgacttgctgcaggaccctaggtgacttttcaggaggtgtgctttgcttaattacctttgccattatcttctttgacaaaaggaggaaagcatgatcttcccgaagcttattctgaaattgggtgtaactaataactcagtactctcttagaactcactccccgggttttttctgtgcataaggaagtactttttcaatcctagaattagatttctctgggtatgtttttttcctaaaattgtcattttctgtgtttttatgatttttctctccctctcaggactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacaggtaagagatccagaggcccacattgtggacattaggccttctgtacgtttcacacactcctttgtttgataacagggattttctctgcccatggtttcagatcctcaccttatgaaaagtgaacagtgtcactctgggttccacttttctcagctctttaattcgaacaaatcaggctgagaaagaaatattttgataaagagtcttcacatctgataaatgctgtttgatagctactctaagtcagaactggatgggttcctgaaggatcaactgtagttcccactattcactagtttcaaaagcagcaatgaatacctctcagttcataattggcttcattagcaataaaggacccctaaatgttccctgttgtcaaagttgctgagctctttgtgccgtgaagaaaaggtgtgctttaacgctaagatagtgtcaggattcttgatcatatgcttttcattttccttaatgattattgactcagacatctaagtaatctagcccaggtactttttgctttttaattttacttcctaatttagaaatctcaaaca

SEQ ID NO: 10249 - DNA, 1129 bp, Homo sapiens
agtgggaatttctatttgaagttagttcttttgtccttttaacatgaccccactatttgtaggggtttccttgccttgttgcacaataaagtatccccacatgtgtctggaacattcttgcccctgccccaaactagtcattccttttaggaaccttgttcctttaagaggaaatgctgtttagggaccatggtctttgtggttatttaattatttatttgaaatatacagtagtgaagaaggatttaatatacttggtaaaaagaaatattaagaagatatagtgaaaaataagtgtgtatttacttagtagatgctccataactttggatgattaagtgatttactgagagaatgaaatgaatggctatcggattattaggatcttttttaaacacccaagtcatttctttctatctgctctaatttcttatgtgaagtacccaagggagaggttttcccatcatagctgataagcttccatcaggcttcacctgctcctctccttttgattagaacggtgtgctgctgaggactgtcttggaccctgtcactggggatttgtctgatactcgcactcggtacctggggtcccgtcctgtgaagctcttccgagtccgaatgcaaggccaggaggcagtaagtaatgaaggttggggacaggcaacatctttgggattttagtggcaccatctgagaacaatctttgctgtaagcttcactgtcactaatttgccactccatcttgattggtttccttcatgtgagaagtcctgagttttcctaacctagagcttcctcactggggctccatcgcaccatgtcatgatttggttatagctgggtagagatatcgatccctttagccctctggctggtcaaatagggctggaaacctcccctctaggacaccactagccatgagaattctcaggttttatcccagtcttagatcagtgtcacgtttactacctaatgtgaaagagactgggaaacattgtgtcctttgtagttaagaatgttagtgtttctgggcactgtgctaattgattccatttaattctgttttttgttgtttttttttttgagatggagtctcactctgtcgcccaggctggaatgtagtggt

SEQ ID NO: 10250 - DNA, 1985 bp, Homo sapiens
gaccttgtgatccgcctgcctcagcctcccaaagtgctgggattacaggcgtgagccacccgcgcccggccaggccgtttgtttttatagtgtcccagggtttgcttcagtctgatgcgagtttacaaggttagcctgagcccagagctttagaactggactccacagactaggattgccaggattgatgggatgatccctcctggggcacacactgccatatggaatcaactctaggtttgccagagtttggcatgttttattccagccaaggaagctgggatcaggaatctgacctcacaaaccattctttatgtgtggcattctctcttgcactgcagacaacatgtggtctccttttggggtttaactatcgtgttgtagcagaaaaacctgtgattatcagaaagtgattagatatttcccgtgtgtttgtgtagtaaaaatgaatggcttgtctgttcgttgtgcttgtggaaactctagactagttgaaatcacttctcagtgacagattttttgtttcttctgccaggaccatgacttcttccagcatgtggaaatgcacctgcggtctgaacatccccctctctgtgggcgggaccacctcagctttcgctcctactacttccctgtgaaggtaggttgggggaatctgagctgaaaagggagatctgagaaaggagcagcacagggagtggattgatgggaatagtaccagggagggtgctcccctcagggcagaccacagccagagcaaaggcttcacctgcttctgccaatctgaactctgagtaccaagagtcaacttaagatagtgttcctggatctacaagtggggttcaagtatcgagtggagaataaaaagttttcccggtctgggcgtggtggcacacatttgtggtcccagccaatcgggaggctgagccccagattttgagagtgcagtgagctaagattatcccactgcactgcaacccggatgatagggtgagaccctgtctcaaaaactaaaaaataaaaacagctttccctacaagtgctgctttagcatgtgccattttctttgggcatctcaccattttttttctttctgctttctccatatcttagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattga

SEQ ID NO: 10251 - DNA, 1120 bp, Homo sapiens
aggttgggaggctcccggcctgtctgctgtggtctgagctggctgcaagcccaggtgggggagcgagtctgggaagattggctttgactctctgttgccggaggagatgccatcccagcacggcccccactgtagtccaggctcgtggtggcagcgggggcaaggggaggggcaaggctgcccccaccccacgcaccaagtcacgccaagtctcagcaggtaaaagcacgtgagcctagggcgagcggagggagtcctggtggccccgcaggtcaggagggaaagcagggctcagagggcatcgtggccccagggcagggtcctacctgggggtcaggagcaccttggtcttgatgattgattgattgattgatagaatggagctgggtctgagcctcccaggcttgagctcctgggagttcttgtgcggtgagctgggcagctcctgggtaggtccgggcaccaagcaggccctgatgtggacagagtcccatcagagggagctgatgaagaatggtccctgtaagtaagtcactaggttcaacaactgcctggccgagcactcagcccgtggagctcaggccaacaccagagccccggttttaggggccaggagagcaggtgaccaattatttggggagtcttgggtagaatttccgccacacattctccccagggctgcaggggtcttccgaggcagggcggtggagcaggattcaggatgtggtgggaatagagtgaggggcagtgggtgggcagacctgggcgtcagaggtcctgatgggaaaggaggcaggggctacccagagaggggggctcgtgtggcacagcccccaccgactccgccgtccccctcccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgtacggagaaatattcttttcaaaagcgtcttttgactgaagtaactttcctggtgctgttgttaactcgttccttt

SEQ ID NO: 10252 - DNA, 1057 bp, Homo sapiens
cactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatgatggcgccaccctccccatcctctcaggccccagtgcgagcaggtggcctggtctgtgagccgcaggcactcagagcaaaggcccagccaggagagaggacagagccagggcagaggccatgccactttatggaaagacacctcacttggattccagcatttaaacaggaagtgacttcttagcaagcctggccaggacggagcctgcaggcctgggcctggttcggggtctgttttatgctcttcggtccctcctcttcctcctctggggccctgcctcttccctacccataagcaccagagccagggccgctgcccatgacagaggggccaggctggcctccctttcaccatcccggcctctcccagggctggtcctgcctcagctcctcctggaatgctggcccccctctcccctgcctgagccccctcctcccctcttgccttctctctgcctctcccaggcccctctccctccaggaggcggggcggctgtggaggggccaggtgcacgctgggctggatgtctgctgggggctgggggccagggcggcaggttggagttgggcggccaggccccccgtgtgggaagggagttccagggcccacgccaagtctcagggaggaaaccaggggctgcttgggggggggggtcttgggggccctgtggtggctcccacccctcgcctcccccaccccgtgaggctggctggagggggccagagcagctctttggaaactagggcagcagggttaggaggccggaggccctggggtcaccggccagccacacaggcaccgttttcagatgtccacttctcattgggtacatcaatcttttaactttgggggtcacagttttagccacctttcggggggtgactggagcagtaggaggtgt

SEQ ID NO: 10253 - DNA, 1143 bp, Homo sapiens
acccctgggcctggtgggactgaggggccacagtcacactccatgctctgcccttggctgtgattgcgaaccagagaccccctgatagccctggacaccctgagcctcagccacagtgacgggcccccgggccataggtggtagggccagtggtccccctgacctgccacaccctccctgcaggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaaggtaggctggccagggccccccttcacgcccaggtcagtcccaggaggcccagccagtggcctcagggccggctccaaccacctggcagggctgcctggaatttgggcagaggggattgggggcgcaaggcttcagcctgcactttcccaccctcagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggcaggcccgcggggctggggtgggaccagggacagctgggacttagccatccaggagggccccgtccttccccctctgtgctcaccctggtgggctgggggcaaggggccacctgggccctgggcctcactgtgtcccgtgcccccaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgcggggctgcccacggccactggcctgccctcgggcgcaccccccggcgtggccaccatccgccgcacaccctccaccaagcccaccgtgcgccgcgccctgtccagcgctggccccatccccatccggccgcccatcgtccctgtgaagac

SEQ ID NO: 10254 - DNA, 1237 bp, Homo sapiens
tgggggagctcctttttgtctcccccaaaatggcctcctttatttccaccctcaagctgctgggccccggctggcctcacgttggaggggcagaactgtagccacagtggcacctgccagatacctaagctggggctggataccaggtgaagctcttacacatcgtgtcaaggcatcttggcagccaccccagggccgctccttaggtagccctcgctttgcagatgaggaaacagtcacatgctcaagtcacaccgctaggaagcggtggagttatggttgggtccaggtctgtctagatcctgtgctctgccagtgcctgcaccccccttcccggccccgccgattggcatcttttcataaacttgaagggccccaagactctctgcttagctgagcagcccacagtcttcctgagaccccttcccaggtccaccaggcctcagggcctggaaacagatacttcctagcccacatggatctgctcctccaaaccagtgaggccaaagggagggagcagaacatttcatgagacactgctggagggtgagtaggaacaggacaggagcccaaggggatctcatcgccaggggcaagctaagcactgggcttgacagggacagcaaggctaccgcattgcaccattatagggagcatcatgcacactagctgtgcagtgcacaacctgtgttgctgtacagagcaactggagagggtggcagcaacaggaatgtaggagctgtaggcatgtccagtggtgagaccggcattcctcctcccagggacagtgagtgactgcaggccttggggccccaacactcaaaaacaaatgtcctgccaagtggagggcccggcagaggctcttcagcaattcccattttccccagtcctagccctgcctctcagagaaagggccaagctgccacctcccccttctccccagaccctgttccaggccccagctggcttcctggctggctgctagccctggctttcaccccaaagggagccactcgtaaacaggaaatgcttcccaatgcgatgcctgctctgggcgccatcgccagcccacaggccgagggcaatagccaagcagcagtgttagctgttcccaccaactgcggaagagggggatgctcaggggcttcccagctctggggcccgccatgacggaagagttgccaggcctgagacagacgcccacaggccgagcccaccagcctgtggctctgcctct

SEQ ID NO: 10255 - DNA, 1159 bp, Homo sapiens
aaaggcgtttttccatcctgccctctcttaaagctgtcctaatctaccgtctttctctccagcacaccctatttatagctctcccgtgctggcacgtgtggagccaactggagaatatgttacactacaggccccgagccctcgtatcaccagggaggcagctgagcggggggcgggaaacagaccaggccccacagcgtgtctcggggttgtggggctgaggtgactgttggaaagatcagacaggcaggtgggcaggtggaaaggaagatgagatcatggaaacggctaggacactcctgggggaggtgggggcagcgcgactggctgtgaaggagcccctgactcgctggaagccacagccacctggctgggtccacacagctgggtccttgggctgtgggtgccatggcaccaagtcccaggtggtcctggccagtcggaggcaggcagtgtgggctgggcgtgtcccagagcagtgccaggtccctgacccctgccctctgcctaccccagatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgagtgagtgccggctggggactgctgcccccgccccctgagcagggacaggcccagaggagcctggtgaggaagggccttgccaggggctgctgaggcctccctcacttcagcatcccaccccttttgtcactgtgaccaccatcccccccgcagccacttgccccttggcctcttgtgtccacatcagagcaccgagcaagggattctgggagccctcacacggtggccgggagtagcaacacttccaggcaatcagggtccagctcagtgaggctatgcaaaatctaaaaactctgagggcatctggagttacccagacagaggaccctggagagaaacaccgggcagggggaggagttcctgccccagcttagagatgggggccccagtggctgtctgtgctgggcacctcccaggcctcacatagcccctccccaccctgtctgtggcagaggctcaaccctgggtcactgggagaccccatcattgcta

SEQ ID NO: 10256 - DNA, 1252 bp, Homo sapiens
ttaggctgaccaagggggtctttggcaaggcctctcatctgtgccgcacatggcattctctgctagaaagggctctgggctgaaatcacaagtggcccatgctgaggagttgaatgtacacgatgttcctaatgtactgtcatttgtggccaggattaggaaggaaatggtgattccagcttggaggaaatccctgtggcaagagagggcaggagcccagcagggacccaagggcttgggcacttctcagcacttcttggagttgattatcatggagacaacaggatttcctttagtgaccagtccctttgttttcatttgcactgaggattcagcatgcaagaaggtccctgcggccgtgccaaggcttcatggccgggggacaatggtctccaggcaggggccagaccggccgcactcttgcccctcctccccgcacccagctgtctcctcaccccggccttgccctcctcacactgcgtttttctccaacaccaagacactatctcagcagataccccatcggtccttcctgctatctcagcttcagagcctccagcacagggttacacgcctgtccccagccctcgccatctgacctgcatccagccgtattctggggtgtgtctatgtgggatagaaggcgcagcctcttttctaagacacaaacgcagacctcattgtgagtcaaacacctgctgagttccctcacagggactccttgcagaatgcgaaatgcttccgccagagccagacacccgccaagaaccctgataacacagttcagaacccacctgactctgaagccccttggcctgcagttccatgtgcatgcccagccccacggccaaagtaacccaggccaccttgtcccttcctggaagttaattttctgtcctacaagcattcatctcccccattgcctgtaggggcccagccctaggccttgtggtgtaagctgaaaaggaaccagggctcagggagggcccaggggccaagtaccaccttaggaaggaaattggtgggaactagcagcaggtgaggcaggagacaggggagggctgtcctgggaaagaacagggggcttgagtacctgtgaatggacacaggggacggggtggtcagactgaaaagacacatggaaaataaggccaaggcaggtgcggtggctcacgcctgtcatcccagcactttggaaggccaaagcggcagatcacctgaggtcaggagttcaagaccagcctggccaaca

SEQ ID NO: 10257 - DNA, 1144 bp, Homo sapiens
aggggccatcagcaagcagagctggaaacctgcaggtccgggtgggcccagcggtgccttgtaccttgatgggcagaatgacttctttgcttccaacaggaagattggccccctgtgggtcaaatctcacttcaaatatttccgtttcacaatgaggtagattctttacacgatctagctcagtactgaatcctggaccaagacaaaaaaaaatttcttcatggaaaagagaaacagcaaacaagagctgctctagagaaagcccccactgggtcagaatgactgctcagaggatcactgaatagcccaagaatccttttagctgatcccagaggcacaaaagctgctccaggaggacagtactgatgggttccttgagagaaatgaccaagtgcaataggaaagggtctccccagcctgggtacctgtctcatgaaggacacgcttgtctgcatggaatgacactggaaagtgactggtgttgatgatcttgatgatgtgggttcggacttcgccaaggatgatgtagccaaagtccaggatgtactctggtagctggattctgaaatggttaatagaccttactagtcactttcaaacctggaaggctacttttccaaaagtgagtgagtctgattttttttttctacctcctgtgcacagttttattctccagagtggagaacaacaaatggctacccaaatggagactagaaacaacgttaactcccccagagattcacaccactgttttggccattatctcagaacatgttcagcatgggcccttatggacctgaagtgaagcctgtccattagacatagctataatgttctcactctaagaggcagaaagctgcccagttggcttgatgctaggggatggcggataagtgaggagagtggatttcattgcgaggtgatcagccagtgtttccgggagtgtgctgcacgaggcagcactgcttgctctgctacactctgaaacaagcacagcacagaaaggcagtcactggaaaccactcacttggccagtttgcggcgactccgatggctgaagcaggggtcatccataggatcaggggtggttgttttctgatgttctaggacatagctttggactataagtctttctacctccatc

SEQ ID NO: 10258 - DNA, 2624 bp, Homo sapiens
caagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtc

SEQ ID NO: 10259 - DNA, 1833 bp, Homo sapiens
ctgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccatgcatatataacatattaatacttgattttgctgagctgcaaaggtatctgtcataaaatatggtccccaggaaaagaatctctgtgctctaaatctcggtcagagctgtggcctcccccttgcctttaacctctagtttagtcttttcctccaggcatgaaaaatatgactaacctgtggtgtgtccattcttccttataggaatttcctgagtttgcaggagacatgagagcagtttttagcgagtattttagtgggaagttgccaactttttaagaatgagcagttgacaagggccagagcctgtcccttgtcagcagtaggacatttccagctcttaggaatagaaaggaggactgctgactgtctggcgctgtataaaaatgtgtataccaatttgggaataggggaacccagtcatggatggataataagccaagtcttgaatcattcctatcaagattagtatacatgaggaagaggtggcatggggggaaggggctctgggagttcagagctgagtacttgtacctgagggagggcccccagccaatctgggctggtccttctatattcttggtcccagttggtcataacaccaagggctttgccctgcgctgctttgccactgctgctgtccgctcactgtcctgcctgctgtcctctacagctccctatccttccatgtctttggccatgtagattaagtgtaggcgtccggttcattcttacctgtgttaggccatgttattttatagcgaagtcatgttcgatagggatggtatgaaatgctgctggtgggctggtaaatccaaagggataaggcttcagtgctgttgggagccctctggctccaaatgtctgactatcttgagggagaaacaagcaggtttctactagtggtgtcttctgttgtattaacttctttcctttgtggtatcttgtatcctgttttaaaaactaaatgaagggaaccacattagggcccatgccagcatcccagtgaagttcgtccagctccagttaggtggattctggagttcggagagggtttaaagtttggctgaaatagcacctcaagtggggtttagttttatttttacctgcgggcatcatgggcgatttagggggaagcacaggatggtggtgtggtttaaacctgcagcaagcaggcatgttgaagagttgagtgatcacgctggagatgaagggttggacatggattgactgggaaaaggcctgggtccattggagtaaagataacctagtcgattgaattggccatgggaagttaggtcacagtctt

SEQ ID NO: 10260 - DNA, 2152 bp, Homo sapiens
ggtgtggtggcatgcgcctgtaatcccagctactcaggaggctgaggcaggagaattgcctgaacccaggaggcagaggtgcagtgagctgagatcacgccaactgcactccagcctgggtgacagagggagactgtctcaaaaaaaaaaaaaaaagtttgtgaactaaggttttctcctgtgttttgatcattttatttttactgccaaaggggatctgagtcatttctctggtatttgtaacgttgtgctccttgccctaattaggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctgctttctctactgtttggtcagatgatgaagtataaatctggattttagtggagaatattttaaccaagtgatccatgtaaaccagcccttagtttcaggattcctggagcagtacagagctcattttgatctctgtatttagatagcccagatagcatctgtgaatttccttggtcttcctcagtggcagggctccgcatctgccatgcctcatccttggatgtttatttttagtaagttgcagtgagctcacttctgactgcttcatttcccgcagccatcctgggccatgggtggtgagttctgttacttgctgcttggcagcagagctagtttgtctcgtagtattcttgcattgttaatcctatcttgacagtgccaagatccataagaacttgggaccaaggggattttgattcctaacttacagaattaaaaacaaagtatattataattttaaagctatgccatgcaaagataagtagtaa

SEQ ID NO: 10261 - DNA, 1207 bp, Homo sapiens
agtcctatttgcatgatgtccgcctgagtggttttgaccctgctgggattgggaatactagtttaagaaaagagctgttgcctgtaacatagctgctctccttgagtgtgtggtcttcgttttattatgaaaattgatgataaaggagataatgggtaaatatgtataagagaccagcatttctaatagtattggtgatagagaaaggacagtgctatggaacaaagctagacaaaaaaatccaatgctgtccttgctcagtattaagttttatagctgatagaattgtaactattaaaaaaaatgattcactgtaaactcgcactagtattttttgaattcttgctggaaaataactgttactgtgggtttgaaattttctaggcagtaactatttttcccccttgggagaatggggataggtgagtttcaggagtccacggatcacattcgagcagtgcaggttgcacctgtgagtgagtgggcagcctgtcctttctctagggtgaagatgtgtataccttaggatgggatgcatgtttttaagcttcgtgtgactcttcatagatgagcgggatagaagtaggcacagcagcagatcagagcgagatggagggtcagagcgtagcagcagaagaaatgaacccgagagcccacgacatcgacctaaaggtagactcactgttttggtggcttgtgaggattcaagtgtataaaaggcagagtgagtgactctcgtcttcagtgagattgctgaggcattgagtcagaattcccgattctaccatgaacatcttgggatagttggttctgagtcaggtgggcacagctctgcacttggggtggatatggttcctgtaaggtgagaggctggtttgctgaatggccagttttccaaatggtaggaaagaatagggagctggaggtagaagaagtgtttattaaaaagaactacttatatccaagaagggtgtgtttgtagagataaagtaaatatcccttaaaatgttgtcataaacacagaatgcaaactggaccattggctaggtgcagtggctcatacctgtaatcccagtactttgggaggctgaggcaggcagattacttgaggtcaggagttcgagaccagcctggccaacatggtgaaaccccatccctactaaaaatacaaaaattagcctggggtggtggtgggtacctataatcc

SEQ ID NO: 10262 - DNA, 1181 bp, Homo sapiens
aagccggctggagggtggagggtgggtaggggactgggttggagaagatttcctggggaccatggggcaaatggggcagcctgcagctctgggactcggggacaaaggactctgctctgggtgaggttttgtttcattatttctttgaggctgaagtacagggcccagggaggcactgtgccctcttgtagaggcctcgcagtcaggcccatgtggaggtgtggtggccctcaaagtccatggctccattccagagcagtgcctgggccactgggctcccaggagatgcccggcctgcgcttctagtacctccctctgactgtgtccccactgctgttgcagaccccacaggaggattacgtggaggctgcagtgaagcagtccttgcaggtgcacctgtcgggggcccctggagacatccttatcttcatgcctggccaagaggacattgaggtgcgtgccttggtcacgactgtgatgagcgggtgtgtcttgcatatgagaggttagggttccagtgtctcacagctcctccctgggctctcaggtgacctcagaccagattgtggagcatctggaggaactggagaacgcgcctgccctggctgtgctgcccatctactctcagctgccttctgacctccaggccaaaatcttccagaaggtgtgtcagcaggaatgtccaggagtggctcttggagttctctaaaggaagcgagaggggatgtgactgtcctggcagggggtgggctaggaggtaggcttttccccctcgcggagcctttcctgtctcgagggactcatttttcccttcctgtatgtcctgctctaggctccagatggcgttcggaagtgcatcgttgccaccaatattgccgagacgtctctcactgttgacggcatcatgtttgttatcgattctggttattgcaaattaaaggtaagagaagacatgggaggcaaggcctgggtgttcaccagaagctaacttagctgcggggtgggaagccagggcctcgctcctggccctgggatgtggggagcgcgtggaagtggtggtggtggtgggaggctcacattgactcactgtgcttggtttgtttaacccttgtaatactcgatgaggtagataatttaacagtagagctcagagagctggtgtttgtggggaagacttcttc

SEQ ID NO: 10263 - DNA, 1107 bp, Homo sapiens
gctgtggcatgtattcatgccgcttcctatggcatttctcttccgatgtctgctttttctttgtttgttgttgactaggctgaatggtggggttttttttaagttaattataaacgaagttgaaatagcaaacaagccaacagcttgtcccccccaccaaaagaaaaattagccccacacaagcgccttctgctgcaacagatgcccagatcacccctggcacgggcaaacgggcaaacgattttggtggttttcagttttttctgtttgttgctgtatttgttgtttgttttccttgtttctttttgatttttcgaggagtccagaatcccggcctctgcttggaacggaacagtgtcatggcggagacgacggcctttgtcttgctgggtgtgaaaacatccgctgtgctggctccactgcggcagaatcaagtttaaaggaaaaaaagtgattaaagtcagctttgtgcctctgtggtgtggaagacccccaaaccccaagtagccgagtcccagggtccgaggaagggctcatagttggagcagcctaggctgtaatcctggcacttgcgccttcggttgctgcttgctgttcgctcctgggggtctggataatctcccttggctttaccgcactgtctggcccgcatacagggccccgtatcatatacccgctgctgctatcacacgaaactgtggcgttgcccctgaatggatggcacggtgccaactcttctgccatccgcccttgcagcttttttcttttctccctccctccccttcttcttctcctcctcccgtcgacttgacgttaattaacactcgggttaattgattttaaaagccgaagaattacagttaacttttcccacagggtacagacgccagccgcttggcacactctgcttttcgcactggtgcaggggaacagggaaagcccgcagcaaagctagcaactgctgagggagcgttgcctgcttattggagtagagccgatagaagtcgacgtggcattgcctcatcctttacaatatatgtatccattatatattttgttaaataatcaaaacaccaccctgtttttcttcttctccgttcctctttc

SEQ ID NO: 10264 - DNA, 1207 bp, Homo sapiens
tgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaa

SEQ ID NO: 10265 - DNA, 1138 bp, Homo sapiens
aagaaaagtagctgaggagtgtctgaaaggtgttgttttacaagtggagggttaagaagtataggacaccagtgattgttggaaaactgaaaaagtcgtgcataggacaaacaaaccaaaaaaaggctcttggaggcagaggaggaaggtcaggaagtgagaggagatggtgttttccttccttccctctgcagtggtagaagtggaacagagaggatggaaaggtactgccttctgcaggtggcgtgggagcagctgcggggtgtagcatggcggtggccctgaagctggcagcctgtactcatggaagtcacctggtcctccatgggggctggcacccaaggcccaaggccgcattgcccagcaacccctcactctgaatcatgcccactctgggagttgactcaccatgtcccctcccagttgctggatccagaagtgacacttttcaccactagtaggacaggtcgccagtggtttctgtgttgctgactctgtcggctgtgtcctaattcgccggacctttcagccgcctttgccactcttgccctttgtctatctctgttggcttctcttctgtgacttcacgatgagtgttattatgcccccaggcttgtcccagagccccttcttttttctgtctgtaactctccctaagtatctcattcagtccagtggttttaaaccccatctactttctgatgacatctgaatctgtccctagcctaggcctcttcctgtatccagctccccacctggcatttgcattcgaatgtctgagaatgaactccgcaggcttagcatggtgcagaaaggactctgtgaccagaacccccaaatgcttatgggctcccccatctcggttagggccacctccagcatatcatttgcttaacccaaaaagctgggaactatctgtggggctccttgtcttttgctcccctacagccaaaccatcagcaagttctgtgggtgcttccttcaaaaatacatttgcaccaccaccctcccaggccagcccccatcgtctctctgtatttcaactctcccccgcctctactcttgccctttacaatcccctctccatacagggattttacgaagaggaaaatcaggtcatatcactctcttgcaaaga

SEQ ID NO: 10266 - DNA, 2399 bp, Homo sapiens
gtcctttttccagggacattgaacctccctcttctcagccctcccctgtgttcccctgacccacagacagtgcgcggagtcggggctgacttcgtgtgagctgtccataagtggtagggctgtggctgtgacctcgtagagggctggagagatgacgcgtccgttctccactgtggcccatcgaagctatgctggcaaagaatggaaattcccgctagtcttcaggggcagagcggtgacaattcgaagccgaagagggctgttcctggccttctttccccatatccctcgctcaggctgttgacccggccatgccacccctgtgtgctggaccgtgtggggcagtgtccccaggcccgccctccgccctgtgtctctgtgttgtggacagaagcctcttagagcgctccgtgcggtaggacctcagcctcggccctcctaacctctttcctttctctctctctttcccctctctccctcctccccccttgcctctgcccttcaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggagcagtccacaggcgagagccacgggcccttggacagcctgagggcccccttcaatgagcgcctcgcggagagcaccgcgtcggccgggcccccctccgagcccgccagcaaggaggtcacctgcaacgaatgttcggcctcctttgccagcctccagacctacatggagcaccactgccccagcgcgcgccccccgccacccctgagagaggagagcgccagcgacaccggtgaggagggggacgaggagagtgacgtggagaacctggccggggagatcgtctaccagccggacggctccgcgtacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcagggccaatgtggcagagggcggcaggaggctggacttcgctgacgaaagtgccaataaagacaatgccacagcaccagaaccaaatgaaagcacagagggtgacgatgggggc

SEQ ID NO: 10267 - DNA, 1152 bp, Homo sapiens
acttgaagcattatcctctccggggagcttaagagacatgcactgtctcctcctgccccatcagaatctgcattttcacaccatcctcagggaccatgcattaaacttaagacactctctgcttcactccatcttcaccaatacaggtaccaagcacagctcttctgtccttggtacctgtattgctaggtaaccagggaaggtcagtcttagattccctgtggtccctgggaggtgcagggatggagatggagaagagggggacgcgcgcacagaggtaaagaagtctccccaatccgccacatcctgtggctcaagggtctcagggcatctaccactcccccgcaacagccggctctctctcgctctgtttatcagccagtcaataagaaaaaggtagttcttacttaaggaggcagaagtcaactcggcaggtcgatcagcactctgtctgtaaacacggtttcccgtaaaatcaatgatcttcagttacagagggcagcctgggaacccagtgggtccccgcacttttccaagcagccctgccagcctgacacgcacacctctcttcaggctccctccacgttctgtgccccttcccagtacttccctagtgccagggctagctggtacaggttcacacccctcctcccttcctgcagcccgcttctctgctggtggcacccggaactccctctaaaaaatgtccaggtattctgctcacaacccccaatgttgcactcaacatatgggcttcaagaattcagttagattttaatagagcacatctctccagtgagaaagttaaagggaagataggaatgacctagctggctcactgtctgcttagcacttaaatctgccatctgaaaggtaatcttgtacagaagaattccagcaccttcatcaagtatcccccaactcctgctcatcttccaagctcccttggaaccacctgtaaagcccactgcatctttgcaaatgtcaatctttacttttcaaagattgtttaaaaggataaaactctaccctgttaccctgtatctccctattaatcaaaacgttcatctccctctttaaaaacatgtgctgatgacagttttatcctgttcccttgaggcagaactgggtaaaatgcaacagtttcaggga

SEQ ID NO: 10268 - DNA, 1120 bp, Homo sapiens
tgggtggtttctgaagacagacacagcacatcaggcagagtggagacttctggctgccagctcggtccttttatgaggtgtctagagtcagctcccctgagaggaggaggctgagatgaggtaacctggttctgcaggtcagcagggaggctctgccctgaggctgtgtgccgggctctctgataatgcagcattttcgctttaatgcatctgaaatgtggattatactattaattactgctggacaaagagggattagtgcagctggcccactttcccctttgcacttttacacttcccctttgctagggaatgggccaaaggccagcgggttttcctgtcatccgtcttttgttttagcggcagtggctgctgaacctctcgtggggatgaatggggaacggtgcagagtcttgaactccatttggcacacgggcgatgcaggtggcacagtttccttccccacagctgggcattctgtgccaggctcctagggtggctgctgggtggcttctccccagcagggcgagtagcagtgccctgcagcatcttcgctgttaaagggccttgctctgtggtgggagctgagtgccaccttcccatggggcgtgcctccgtgggtgttctgatgctaatggaagcccccaggtgctgtgtacctttatgagtttttttttttttttttttctttgagagggagtctcgctctgtaacccaggctggagtgcagtgatgcaatctcggctcactgcaacctctgcttcctgagttcaaatgattctcctgcctcagcctcctgaatagctgggattacaggcgtgcgccaccacaccctgctaatttttttatttttactagagacggggttttgccattttggtcaggcttgtctcgaactcctgacctcaagtgattcgcctgcgtcggcctctgaaagtgctggaattacaggtgtgagccaccatgactggcccctttgtgagtttcttaaatggtcaagtaaagtacaaaaggctggccctgccatctgctgctgggggatggaggttttggtagccagcaattagcccatgatattgtatttgagacattctgaatgcctaagtttggtactaacacc

SEQ ID NO: 10269 - DNA, 1495 bp, Homo sapiens
tattacagagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaagctgtgttctagtcgtttttgacttcgggagtagtgatctgtagtttccagaagcagccaagacagtcttcgattggagctgccttaagttctcttgcacttggtatcatttatgaaagagcatctcattcccctaaatggaaacaggcagtctgctgtagtgaggagagttctctgagcccagaagacccgggttccagtttgtacctcagatccctcatttatgaggtggtaggttgcagtccgtcatctctgaagtccccagaacagtgtttcaaaagggacacatttaccacactgcagcaagttgtaagtacctcagaccacaggccaaacaggcatgttactaagaatggaacaatgtttcccccaagataagtgcacaggactcctagaggaacaaattaaataaggcactaaatcatttgacatacagtagtcacggatattaaatttcctctcttgaacagatagaacctctcaaatg

SEQ ID NO: 10270 - DNA, 2147 bp, Homo sapiens
cacctgggtgcatgttggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgcccacttcggccttccaaagtggccgcaaagtggcccacttcggccaaagtgcacttcggccttccaaagtgcattacaggcgtgagccaccacgcccggcctggccttttttttttttttcttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccacgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcggg

SEQ ID NO: 10271 - DNA, 1586 bp, Homo sapiens
aagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcacagtccacgtgcactgcaggaccggagcgacacatgtcttccctgaagggtgttcagtacaaggcgtgtcagtttgtggatcagttgatccaagttactccttgtctaacctgactgacatatatttgaatactgtggttttctttcttttttttctatttgctgcccttcctggaggcagtgggttccagaagccaactgattgtccccctgccaagtcaccaagggaagctgctaagctgcttagtcccctcggtcctgcttgtagggtcttcctgattgtcaacagctgtctgggatgcttcagtctcctaaaactggaaacgcagggtgcgagcagcacacactgcctcccgccactgccagccggagtgagcggcccgagagtctctgcaggttcccctgggggctgggggccgctgaggcctaatatcaagagccaggaatgtcatgtacatggaggtgcctacggacgtgcctggtgtggtttgcaggtaggatggatgttcactgtttgaccgggtggggtatccttcctctctgcagtctccttcccagtatgcgtaaacacccttatagttctaattgtgttgatatttctgttctttctgaattgagagaaaatcccattcgttgtctgcagatttggaagtttgatgaggaatttggttcttgaaacatctgtctttttttttttttttgagacagagtatctctctgttgcccaggctgcagtgcagtggcgcgatctcagctccctgcaacctccacctcctgggttcaagcaattctctgcctcagcctcctgagtagctgggattccaggcacccgccaccacgcctggcttatttttgtatttttagtagagatggggtttcaccatcttggccaggctggtcttgaactcctgatctcatgatccacccgcctcagcttcccaaagtgctgggattacaggtgtgagccaccctgcctggccaaaacatttgtcatctttataaatggtcagaatagaaaagttagctctgccagtatcttcaattacttattacaagaatgtctttcatcatcttacttggagcattttccaatgactggctcttgagagccc

SEQ ID NO: 10272 - DNA, 1135 bp, Homo sapiens
ttatctcctgccctccctctccaaaagaaaagacataaattaaactaggaactgagagggataagttagacctagcactgccaccagcccagtgctctctcagagaatcacattgccttgtgtcattctaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcc

SEQ ID NO: 10273 - DNA, 1193 bp, Homo sapiens
aaaaaagaaaagaaaagaaaggaaaatatttgaaaactaacagggtattacatgatagtaaagcttttaaaataattgcttagtggtgtgataatggtattaagtccttatattttaaagaaacatgctgaaatatttacaaatgaaatgatggagtatctgggattttgctttaaaatatcagcaaagaggcctagagttaaaacagacttggccacagattgataaagttatggggagggaaggtggctgttacattattctctacttctttgtgtgttggaaagttttcataaccagttaaaaatacagcagctgcacactgcccttgtgcatgcatagtcttcagtgctgagtggctctgaagttgatcgaaggtataaccactgtcaggttcagttaatttgagtgattcttagaaaaataaatctgattgccctaagaaaataactaaaagccgccttctacagaccagggaaatactatattgacatagagttctgaacacttctctcttgttacaattttacacatttaatggctaggatcttgtcgtgcctgatggaacatttatacacagagaagatggtagaagactgtgaacaccgtctcttagagctgcagtatttcatctcccgggattggaagtgagtattttgaagccaaagtaaatgtattgcctcagcctcttctcctgtgtagtcataattacctgtatttattaaaataatcagtaggaaactctttttgttcagttctgggacagctaacacactccaatcccctgaaaaactattctttatcactttcagaacattatctaaaagcagagtcagcccactaccagcctgtaccacacatccttgttcaccacgactttggaagtcagggtcaaaatgtttctgatactacaaagatctgtctagtaagaagtatggcacctgtgggggtggcaaaagcgccttcagatatgtctctaagaagataatagtgcagttgtatttttattgatttgcagtggatatggtaattggcttttatttatttattcagagttactgaattaagtctgtcttaaggggtttttgtcaataagtgacaacttgattatctaatttccctctcattctgttaacaaaaagcggtgggggtgggaggatgaactaggagaaggatccgtattacagccagaa

SEQ ID NO: 10274 - DNA, 1223 bp, Homo sapiens
tagctgaagaaatgtttctcatttcctttttcttgtatcatttgaacaatcttattcaaatcttattattcagatgatatagaataattgaataattgtattttaaagcattgaacagaatatcccaaatgttatgttagttgccagtttgatgctagtgaaatttatgttcggggtattgttaaagtggaaaagaatgctgtgtgtcaagttaacatattgggatctgtgagatatttacatgttttggatagctgctattgcagcaacaactagcaagtgactacagaatttctaggttccccacccacttacccctgtctcatgccacactagtttagctcaattgtgaacattttaaccaaacttaaagatagatatgttggtaataactgcagttgttgacatgtacttggctgagtcgctgtgctcatcttagtggtacacgtcaacagtaaagttacatgagtggtctcacggctgttgctgtactctttcctcagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagaggtagcattcatattttttttttaattatcatttctgttcctttttggattcacactctaaagctttatatatataaacgttagtttcctcccatatttgcttctttgagtatttttcttttttttttttttttcttgagacggagtctctcgctctgtcgcccaggctggagggcagtggcgcaatctcggctcactgcaagctccgccttccgtgttcacgccattctcctgcctcagcctcccaagtagctgggattacaggcgagtgccactgcgcctggctaattcttgtatttttagtagagatggggtttcaccatgttggtcaggctggtctcgaactcccaaacttaggtgatccgcccaccttggcctctcaaagtgcttggattataggtgtgagccaccgcacctagcaatttttttttttttttaatagagatgaggttttgccacgttggcatcccgggtctcaaaactcctgccctcacgtgatcctcccaccttagctcccagagtgctaggattacaggc

SEQ ID NO: 10275 - DNA, 1114 bp, Homo sapiens
tattcaatgctgtctctctctttggctaagaaagacttctgaggcagatggaaggaaggaaggaaggagggagcgatacaaggagaggctttccgattccgtaatacacctggttgtgcaaagttcacctctacatataaagtttttgttttccaagtcattgaaccggcgacatattctaccggccattttggttgtggcaaccccaattcccttgatttttttttttgtgacagcaaatggaattagagtaggccgccctgcccgggctttttaagaaaccccagcaacccccccgggtaaggagcgccgctctcccgcccgccggtccagggtgtgtgcggtttccagcacggcctcctccttcgccccactctgggttcgcgggtcggcgccggcggggcggggctcggcagggccacgctgccacgcccagcgtctccaccccctcatttaaatacgcggcgccggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggaggtgaggaggtgggacgaagccgggagggccaggcctggtgcgggcccgagggtgttgccggccttggaagccgctgacgccggtcggctgctttccttgcttcctctgtgctgcactcgctccttccctctttgctcctcactcccaggcgctttcagggaaaaggataccactc

SEQ ID NO: 10276 - DNA, 1230 bp, Homo sapiens
ggaaatttagaaaacctaaaacagtcctgtttctgaattaaaatgtagctgcttttagctgtattttaattgtggggtctgtcaactacaacttgggatctttattttgttatgtatataagctttgtttcttttctgacttttcttatgtggctaaacccatttccagaagcttcacatcagtcaagcttcatagtaattgtgatcttgtatcccttaaatttcctagttctttttttccttttcttttagagcatctggtatctcacctgaaattagttgcagaatattatatgtatgtccttttgtttctacagagagggttgataatttttatcagatatcagaggatagtgactaaaggcgtttaacctcctctgcagaggtgggaatgtgcttgaggtctggtagtggggtctggagccgtccgagttttggagtgtgagatacagtttccttactttcctttcagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctggtaagtagtgctggggtctcccatagcttatttgggagcacagtggtagagaaaagggaaggagggtttgatcctaccctttgggtggctgtggtaccgctcacaggctaacgaggtgtgttgtagctcttgctactacagggagtatggtggctccaagctcccccacagagcctgcctccctgctccttacgtgtgaggactggagcatattctgccaggtactcctggaagtgaattagccacttaggagcccctacagtttagaacagtagtggaacaagggggccagctctaggtcattgagccaccttgagatcactttcgtatcttctgcctgcctcttacttcccctgagagaaaggcccagattagggcagccatgtagtagcccggctggcatactgaaatggacaacagtggctgtgtgtgcccagccagctgaacatctctgcctctggaatcagaggtggaacgcataacagcagactgtgcttcattcacaggttctttctaggctaagcggcatgaatctaaattcct

SEQ ID NO: 10277 - DNA, 1214 bp, Homo sapiens
aaccccgtctctactaaaaatacaaacttagctgggcgtggtggcaggtgcctgtaattccagctactcgggaggctgaggcaggacacttgaatccgggctgtgaaggttgcagtgagccaagattgcaccattgcactcgagcctgggtgacaagagtgaaactctgtctcaaaaagaaaaaataaaaataaaaaaaacagaaaatgaaaaccactggtctaagagaatctgctagagtcttgagaggaagacttccttcttcctggcaagccccagtttcctttttcagaactaaactcatgctgcctcttgttttgcccgtccctgcccatttccagagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaaagagagaaagttaaac

SEQ ID NO: 10278 - DNA, 1233 bp, Homo sapiens
agctacccagtagtttgggttttgccaagtaaaacatgtcagtcctgaagcgagcaagttttcctttgagcagttgcagtgccgggggggcgggaaggtgatgcttcatgtggatggcgtttttctggtgcatttccacgtggcaagaattaggtctgctgctccagggattttccctgtcagccctgcatgctcattctgggaaagcactcagtatctcttgagtggtaactcatggagagtagctaggatgtgaaacagtgtgtttcattgcatagcaatcagtaccatttgcttattttagaattttcaaagttcttcaagcgcttgcctcagcctgagttttcacttgctttggtcccttccataagcaaagagaaaagtagacgcgatgtgcagcctatggtgtttgggaaaaatttctccagatgagttggggccttccattatctaatttattttacttaggaagaattccaggtttggaaactcaagactcagctgattctccctgaaataatctaatcacctgcttttcccttccctgccttagcctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaaggtgagtgggagaggcctgctgcccactttccttctgagctctggtgacagcggtgccagtcagtgttgccatggagtccagtaaagaagacatagagagagctgggctttaggaaccagagagccagggctgttgccacctttcgtcataggtgagtaaagggactatataaggctgctgttactcttccaaattctgtcctcttccacaattgtcagcgtagtctctcttgcttggaagagatatgctccagtaagagacggaagatagagatttgctgttggattgtttctgggactgaaagactctgggctcagaagtccagggcatttgccccttgccactctgttgatgagggagacccaaggtggtctttagtactgcctactacataccctcagttgtcttcacaagcatgtagtgctctgtctcaaaaaagaaaaaaaaaaagaaaacagatgatgtgatttcctcagtccagtggggaggggttgaccggtagttttggatggaaataaagttt

SEQ ID NO: 10279 - DNA, 1202 bp, Homo sapiens
gttttgatgtatgtatgcaggaggcctagctttctcttacccaccaattcaacacaccactaaagccaagaaaaacagcatcaccatgctgctgtagagaaaagtgaggctcaaagatgttcattcctttgcccagctaatcagtgagctagagctaggacttgaacccatgcttgtgtaaaccggtattctttcttctgcccttaaagtcttgttagaaaattgcaacatcttcctgccacccagcctctaatatactttctcattgataagctgttgccttccttttattttcaccatccttgtttagaccaaatgtgagtggtttggattgtactggaagagtcatgggtggtcactctcggcaccatttactgtaacttagtttatccctgggggatgggactgtgcaggggaggagtttttcctactggattctactgacaaacactgttttcatcttctaggtacattgaacggaaagccttccttgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgacgacctcgctcaccttccctttattctgccgcaaagtcccacccagttcaagacagcacattccaggtctgtccaggctggcagaggtcttgccaggcatggtgaagatagctgaccaacctgggtgtgaattttccggggccaagaggctctttctgcagccagccttgccccgaagacctagaggaggcggctcactagagtgactggaatgccaggccccttcgcagcttgttctcatttccactcgggcttctcttctgatctctctttctcctgaatggattcctactgatggcatgtaaggctgaaaataaggatatattattgctgaattagctgttttttcccttcagcctttttcctcttcccaaagaaaagttaaattcagatatgctccca

SEQ ID NO: 10280 - DNA, 1233 bp, Homo sapiens
attgcaccttgacgctgtgccaagtgctgttttagccctttacgtgtaagatacaccacagcctgtgagtaagcatttgctttgtagattaggaaaccaaggaacatgcagtaaataactggcctagagtcacacagttaagctggaagttggaccttggcatgtgactccaaagccctgcctgaagcgctgctcctcccctccttgcaagcagagacctgccacacagagcccacagaggtctgaagaaggcaggatttcctgttcgtagctcaggagagcagacagtggtgttaagcaggaaaagcacattagaattccagtttacttacagtgctctccacaccaggaaggaaatgccccaaatatgaacatggcttccactaagataaatggccccaatctaggggattcccatttgcatcagaaaaactgttaatatagagatcagagtttttacctgctacatctttcatattttctttccttaggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtaagaaggagtaggttttatgccttggaaaatcctcagaaccctgaaatcaaatgatttattggagacaaactgcccactgtaagcaagcaggagcttttcatgatggaactaaaaatgtgagcactttggtttgtcagtaagtctctgttccagtgtggggcagggcctgtcactgggaaggccactgcgggtggagggaaggcggggcatgtgaggagtactctcaggggccagtcacatctgccaagctgaatttgctgaattacagctccagtgaactgtaagttgcctagtggttggatctggcctgtggtagcagccttggccttatctgaatcatttgtccttctgagaaaccaaactagttcagatccgtcaaaaactgagccaatggaatgcctagatgttgcattattgtgaatttttttttgtctgtgtcattatggcctggggtggggctttacccttggctatagcctgtgtgataggccaggccctcagacagcaccccaggccatcacttgcacctctttctcttcgctgtggaatacaaagagaatgttcataacctacgtattca

SEQ ID NO: 10281 - DNA, 1198 bp, Homo sapiens
tgagactctattactacccctaggcctgaaagggcaagagtgggagcagttaatggcaggggaagaaagggttaggtggaatggacctcctgacaggagctgagaccttctgttaagtgatggacttcccccagagggaagccaagggaataaatacccagatctgtttcttctctctctgcagcctcttagggtactccattgccctctgaggcttattaaagaatattctgacacttgttaaaactgtgagaacactttatccaaaactattgcagtgggtctcaagactatctctggggagagagagagtgctcaactccgaatacagcaaagacagctggggatttttagcagaatcgggaggcaggtggtcagtggatagaaaattactaagaggagacatcaaggagagggtgattcttgctcaaggcagggtagtgtgatcagatatcaagggtaggggattctctctacactgacttagcacagaattctttccaaaactgcgctgtgcaggccagcaagggcaggggccaatttcaagccttagttgagaagagggctcagtggagtctgactaaagtttggtttaaggagagtcttcatcaggctgtcctcacagagcagctcctagagcagagagccatgtgggaaagggtatagagggaatctaggggccaaccaggagctaccttgggagctatacaagtgaaatatttttcagtaaagaatgctgactcccttataaacagggtaaagtgaaatttgaccaaaatcagtttctttgaaagccctgatggaacataacacattacaaggatatgtctgccaagtgcctgagtaaaagtccttagagttgtacgtgaaaatgtacgtgtttaattatgatactgtgaaccttggatttctgagtagatccagaatgactttcaaggttggtatgctcatttttatgaaatgcatctcaaaaagctttacagttacaattgtgcttgggaaaagacgggtccaagaggaattcagctgatctggggtatctgagtgggcacattttatccgtgcaaatattagtatctgtcagcagactccatttgcagagtatagaaagtcttttcaagggaaggatctataggaataatctaatattttaaaagaaaattaacacagtcaagtttttttcccacagacttttttc

SEQ ID NO: 10282 - DNA, 1139 bp, Homo sapiens
cagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcatgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctgagttggaattatatttctttttggtggctaatgagtttaatcttttgtaataaaattgacttcagttttcattttttaaataacttaatatctagcatgtgtaactttttttatgttctacttcttactaatttatgataaaattcttgttcaaagttgtgattaaaccgtacttaacatgtgaacttgaaattcttattaactctacttgctgggccatatattcccatcaagaaacttttgtttgattctgtgcaggaataggtgagtattgatacagtgtgtgaaaatgtattattttaatagtaagtccacatgaagagaagcttcgtcgtgtttg

SEQ ID NO: 10283 - DNA, 1216 bp, Homo sapiens
aattagaccacttatggctgggcgcagtggctcacacctataatcccagcactttgggaggtcgatgtgggaggattgcttgagcccaagagttcaagactggcctgggcaacatagtgagaccttgtctctactacaaaataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattttaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactg

SEQ ID NO: 10284 - DNA, 1733 bp, Homo sapiens
gaaagattccaaagttgtccccagcagaaacacatgtgggagcctttgattggaaattgctacagcactgtatctccacataaatgactatgtctgctctttatacaggggggaagatcatttcctgttcgtatttctttctgagccattcttctaagtcagaatcatccatatttattttttaataatcttttattattcctttcatcttaagagtatttgaaatattcttgccatatcctgtctggcctaaaccttagtttactttgacttataccatgtggtccccaactctttaactgtctgtccttatcagccaggattctgggcgatggtaaagttcgcctgggtgcagtatgtcagcatcctgcttatcttcctctgggtgtttgaaagaatcaagatcttcgtgtttcagaatcaggtggtgaccaccatccctgtgacagtgatgccccagggagaagtgtgtaaggagcacttatcctagaaaggccgtttctgaagactcagcaggaccatggctgcctcattgtcatcttctgggaacgtcttaggaccttttgaaagagcccagcggacacctgcgggcttgtgtgcttttccctcagagacaacggttctttccagttttgctctacacagttccgtatcttcagagctcctgcagaattgtcagggactagtttgtggaaaggtctgagagttcctggaggctataattagctttttgggtttttcttctttgccttagcgttgaatttcaggagaaaattgcagtcagttcagacatcttggaaagagtcccatctctggtcaagcagagacttttcctctgttgaactgaggaacacactgtgcatttcttccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatccctgcccgactgtggctggctctttgcccggtttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaaaagggtgcccatcagagtggggcgggcagctttgggaaggacacaagaagcagtgagggtgtaaagaggatgctggcctgggcaggccagtccagcctggccactagcagaataccaagcagtccagtggattatcctcgtggctaagcaagtgtctgcaggagcagagatggctggaaggggcctctgcacacggaagatggcttgttcagccgattcacctcctgaggatgcgtgcagtctcctccaagaacacatg

SEQ ID NO: 10285 - DNA, 1171 bp, Homo sapiens
cctgaaacctggactccaattttcaatgacgtttttgtttttctctttcaagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggcattgtactgtggccatgtcctttattcacccgcatttggatgggccagagaagtggctcctacatctgccagaccaggaagagggcttgtggaggtcatggccgcacatcctgggtcgggaagccatggccagggtcatgaggagagacattgttttgaataactaatatgttcacatgtttgaggtatcgggacaatacaaaaaggtatacactgagaaggcttgctcctgccagcttcctaaccacctctgccctttatgggaaattacttttactggcttcttgtttcttttcaatattttaaaagtaaataggataatttaaaggacagtataatggcacagtaaaaaggataattaaatatgaatacatatccttattttctttcttcttttttttttttttgagaccggagttttgctcttgtcacccaggctggagtgtgatggtgcaatctcagttcactgcagcctccgcctcccgggttcaaggagttctcccgccttgcctcctga

SEQ ID NO: 10286 - DNA, 1882 bp, Homo sapiens
aagcgtgacgcttgccttgaaaatacacttgccaagcaagaacattattttcttagattgtacatgtattaaggtggcttagggctgggaggtaggtagagatgaatggagaagacagaacccccacaggctgcctgcagcaggtgttgacagggctgttttcaggaaatgggagaaagactcttgtaattgtcacagtctctgagaattaacctgtttggagtcccagagccccaagcagcagaagggttttctttcagagaaatttgtatgtgttctgaggtcgatttcatcagtcctgacctccaggtctttgaaagaaacggctgcatcttggagttactaggaaatgaattcccagcaagtcctgagtgtcaggagcatctctggaatgatggtactcccacctcggagcctggtaacatgttcactcacacactgagatatcttagaagaaggtcaccttttggttctctttcctcttctaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggtacgtagcaaccctccacagagcacacttcctgaggaagctgcattgtgttggagccagggcatggtgggcctggaggataaaattaaggaagggctttgggctgggaagaggagcaggcagaggagttccatgccactcacaggagggccagagcctctgaccttaaaggatttgggttttttcctaccaggggcagaaggaatactaattgtttgcatttcttgaggatccagggaagtctccgtgcattatttcagctaattaagtcagccttatgaggtgtagaaactgttgtttcccatttttatagatgaggaaatcaaattttcatagaaatgcgtctattcatccttttgacatagtgccctaggcagtgctatgcatttgttctttgtcatctgtaacttgagagggtctgagttgaaataaaagaacacatgagccttttcagctggaatatactaatctctggattttggtggtaacaacagaggcaagaggaatgggtagatagctgtgaaaaaatgttgagagtgcttctcagcttcaaggtacattcttatctcccacaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataagccatttgtctcttctctttacttttagaatatcaacttttttccccagacttctggcctaatgaatgtttaggattttaccatcttattcatttaacaaatttgtattaatgtctgccctgtgccaggcattattctaagagattggggacacagcagggaacaaaagccaagttcctgcttttgtggaaattgtattctttctttggggtagggagaagaagtagacaaacaaaaaaacaagtaaatacatgttctttctggtggtggtatatactaagaagaaaaatggagcagggtaaggggacagaggtgctattttagaggtggaaggaacagtgctactttatggtggtcaggaagacctctgctgggcatttcagtagaggtctggagactgagctg

SEQ ID NO: 10287 - DNA, 1116 bp, Homo sapiens
catggaaatcacggagaagatggtttcaggtgactcctgctctctctcatactcatcgggtggttggtatgctgctttcagaggagggctgcctggatttcattcccgctaaataacaggtttctctcccagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaaggtaaagtgacaacactcactcctccgttgtaaggccctccttcctgttcagctctgaatttgattgggtcagagctagaatttcccacactattctctttatgtacatttttacttggctagtgtgatgtctcctgccctaacttttgcatttgtgtcccagaaactcgcaaaattcttgatgatatctgtgtggcaaaagctgttgaatgccctccacctcggaccacagccaggctccttgacaaggtgagaaggccctgccttcttgtacatgtcctcatctggtgctgaatggttccctcttccctgggaaaatgaaccccactggggagagttcatttctgcagcttcacaggaaaaccctagagagagaacaagagaattaacagacttttaactgtcatactaagctctgtgccaaataatttatgtgtgtgatctcagttaatcccgtccagcttttaaaaagctatagggtagggtgggcatggtggctcacacctgtaatcccagcacttcaggaggccgaggcagatgaatcacctgaggtcaggagttcgaaaccagcctggccaacatggtgaaaccctgtctctacaaaaaatccaaaaatgagctgggtatggtggcgggcacctgtaatccccgctattcaggaggctgaggcacgagaatcactggaaccaggatgcggaggttgcagcaagccgagatcatgccactgcactccagcctgggcgacagagcgagactccatctcaataataataataataataataataaataaataaaaagctataggata

SEQ ID NO: 10288 - DNA, 1212 bp, Homo sapiens
gagtgggacatggttggggaaggctgagaagaggataatgtggccacctggtcacctgtaaagtaatgactactctcaagttatatgacagtaaagtaaaggatagtccttttttaatagtggcccctgaatctgacgtccttcttgggctcacattaactaggtattaacagttgagtgagggttccagaggagaccagtggtcagtgttcatttgaattgttgttactgaattacatttctttttcactcagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggtaagcgttcttggcctcctagctgtggcctcctagctttctgtttgttttatcatacctttggatcagacataccagtgatttctaactgctgcttttggtttaggaaacaaggtatcgccagagatacttggacttgatcctgaatgactttgtgaggcagaaatttatcatccgctctaagatcatcacatatataagaagtttcttagatgagctgggattcctagaggtaaggagagttccttgcctgacgtgatgagctgccttgcaatgcttgcctcctcctctcccttgccttccttttccaaagcgtatcctgtgtcaggatccttcatgcctaatgagaatgtccccttttcttgccatcgtctctgttctaccttgtcctgattaggaaggcaggacctgacttccaagataatggacaaggtatagggccatccacatgctaatgatgtcacattcaatatgtattcacgtcattttgcttttttgtagcattaagaaatattttttgattatatgagaaaggcaaacacacgtaccataaaacaaattcaaacaataaattaaatagaagcaaaactgaaagtgctctttcactccttctgactaacttccctacccaaacttgagtttgatatgtatccttccacaccatttactgggcatatatacgtatgtacatatgcatgttgcagatggagtgcacatatgtaaacattttggaggagttttatttttggtttaaatatgaatgaagtcaca

SEQ ID NO: 10289 - DNA, 1514 bp, Homo sapiens
ttttaacctaaaaatcttgatatatactgtaactaccacaatgacatgtagtgtgcaagattttagaatttaataaagcatgttcaaaaatcggtgctaatgcaggaccacaaaagtattcctaaaattatgctacattgagtaatatgattttttgtttgtatcatatcaatcagaacaagtactttatgagtttgaacatatggggagaatttagcaaatgaactttttatcttaaaagttaatagattctccacatgtagcaatgcattagtgaagctattatctcggaaagattaaaaaataaagacacaaatggagggaatttctgcaagagagaggggaaaagaaagggagagaggagaggaagaagtcttaatagaaaatgtgcacattggccgttctctctttccgtacctggccgagcaggagacgccatcatgggagctgacatctgccacaacaaggaccgaaaggttcggcgcaaggagcccaagagccaggatatctacctgaggctgttggtcaagctgtgcagttttctggccagacgaaccgactccacattcaaccaggttgtgctgaagaggttgtttatgagtcgtaccaaccggccacctctgtccctttcccagatgatccagaagagtgaagcttcctgtccgggaaaacaaaacggccgtgattgtggggagcataacagatgacgtgcgggttcaggaggtgcccaaactgaaggtgtgtgtgctgagtgtgaccaacctggcccgcagccgcgtcctcagggcagggggcaagatcctcacttttcgaccagctggccgtggactcccgcaagggctgcagcaccgtcctgctctccggtcctctcaagggccgaaaggtgtacgggcattttggcaaggccccgggaaccccgcacagccacaccaaaccctacgtccactccaagggccggaagttcgagcgcgccagaggctgacgggccagctgaggctacaaaaactaaccctggatcctactctcttattaaaatgattttggatgcaaaaaaaaagaaaagaaaagaaaatgtgcacattgacattacagtggggggtgagaaaaagtctcttaagtagcattttacatgaggttcctcattgttggtttactccaaatgttgtcaaacttcacggtacatgagaattggctggagggcttaataaaacgcagatttctgggtctcacccccagattctgatttgtagttgggtaggaccccagaattcaaattttaagttcccagctgatctcatcctgctggtctggcgaacctcacttggagaaccactggtctagtttgtaacagattgacagactactgcttcattctacatgtcggtaaggaaatctaaaaatgttttcatgaatactacataggaatgatacaattcgttttcccagattttacctattattgttaagaataagctgttaaagtttgttacacatataaacaattattccatatc

SEQ ID NO: 10290 - DNA, 1715 bp, Homo sapiens
gagactccgtctcaaaagaaaaaaaattctcccttggccgggcttggtggcttatgcctgtaatcccagcactttggaaggccgaggcgggtgggtcacctgaggtcaggagtttgagaccagcctggccagcatggcgaaacctcgtctctactaaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagcaaaaaaaaaaaaaaaaaaagaaaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaaggaatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcat

SEQ ID NO: 10291 - DNA, 1086 bp, Homo sapiens
gactgtctcttgttattacagcgagggtataactctttaggatcccgacccaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggcccccaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaactgtggccactgaaaatgtctccagacatttgcttctgtcccctggggatcaaaatcacccctggttgagaacttggggtaatttaagtggtgctccggtaaaggccattcaacatgactcactgtgttgatgttatgttttctaacattgactttcctttaaaccatagggttcgaaaccgccaagtcttttgccctccatggtgcacatgtgatcttggcctgcaggaacatggcaagggcgagtgaagcagtgtcacgcattttagaagaatgggtaagtgcttgactgttgttgttttttttaattgtcaaatacacatgccgggctaaccatatggagatttcagtggagtgtgtaaagtttattgctcttggaatcatgtctttatttttaaagtcatcttcacttt

SEQ ID NO: 10292 - DNA, 1114 bp, Homo sapiens
tttccatctcattgatacctgccttgcgttctgttacctggaagcacaggtcaaggtagtcttcttgttccactgatttgatgggggtcaggatgctttcagaaaggaagtgagaagagtggcttagaacagggaaaatgtggccgggcgcagtggctcacgcctgtaatctcagcactttgggaggcctaggtgcgcagattacaaggtcaggagattgaggccaggctggccaatgtgatgtgagaccccatgtctactaaaaatacaaaaaattagccgggagtggtggtgttcgcctgtagtcccagttactcaggaggctgagccaggagaatcgcttgaacctcggaggtggaggttgcagtgagccgagatcgtgccgttgcactccagcctgagtgacaagagcaacactccatctcaaaaaaaaaaaaaaaaaaaaaaggacagggaaaatgtccaggaaggatgtggcttagctgaagatcagcttcagcttgatcccacgggaagctctggagggtgaattgtacagcagagttggtcctgactgagaccagggcctggctgacctatggcagtcagcgatgagccagtgtctgctggggaagagggcggcgtggacatagcctctcaagtggggcaggaaggggtagctgtgagatactagctaattcttacagcttctgggttcaccagcccggcaggagaatctgggttgaggaggcaacatgacaacgtgcctaccttcaccagagagactgctgtcaaaaatcactccatccatgcaaggaggaacgatgcagacacagaaattctctgctgtgagggccagcactgtagtatttactgacctgctccccactccacacctccaagtgcaggtgtacagactgacatcaaacctttcatcccgccctcggcctcatacctgctttccactctgtgacctatttacttcgatggagtcattttcaaataacttttgtttagtgaaactcaaggcttttcaggatgctgtgctaatgtcttccttttttaattgagtaaatatattatacacagctgggtaggttgtttccttgctggccttactgctacaatttgaaaa

SEQ ID NO: 10293 - DNA, 1108 bp, Homo sapiens
ggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataaccattattgctgtcattattaacattattttccccagctttactgaggtatgagtgac

SEQ ID NO: 10294 - DNA, 1192 bp, Homo sapiens
ctttagaattatgggctggagcagtttttaatactctatttattttaggggaggaaaatgtttttctttaaccacaacattcatgcaataccaactgctggcagtttccccagcatttaaggaaatattgttgtaagacttttatgttctgtacttcaatcagctagagccagcagtatcccaatggaaggaccctcaacagaccattttcagcattttgctacaattaaactcctctggttttagccctcaggcaatttagtacctttttacatatgcacattatgaacttttgaccagggtctagcagtcatatattagaatgctgctcttgaaggcaggcttaacaagttcctctgagtattacagttggagtcagttgtggaaaaggtaatttaagcaacttgcagcgaggccattcagaatctcagcgatgatcctaaatatctttctctcttgctcacgctcttttttttttttcttgtttcctctggaagctggtagcaggagctttcaaagtctgtgattgatcttttattcagtagctaacgagggctgtgattctattagcgcactacaaggcaagagaacagtgatttaatgaagtgtctagtgagccggccatagatttatcctgttgtcgctaatttgcagcgcacttgccagcataaaggaaactgcactcacactgctattaagcaggtatttccttagtaaattgttgtaaggtcaggtacagttatctgagcaaaagcaatgccttacctcttcagtgtctgcaaatgacagccgccgtgctgagcgctcactgaagtggaaccgggagatcagaggtccgtctccaagtcgcccttagcggaggcaggagcagatgaactgccaagtaggagtaatagagtcataattggtgattagaactggaaaggtgcaataacatcttaatacaaactggcgtatgttatagttactgtcagttgttgtaaactcgtcctgccgcctggactagttacgcttcccttgattagctctgagaaacgaggcagcgggcactggggcagccacatagacaacatctaaatttttgttgctttcctgggtcttgccctgtccttactgtttcccttgggcacgctgttcaccccttaggacatactacagtaaccttttcccaccaccgtgggaggactgtgat

SEQ ID NO: 10295 - DNA, 1128 bp, Homo sapiens
gctctgagtcaagcagacctggaattttctttatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtgtctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgaggttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacattcgtgagctcttttttttttctaaccactttcccagtgagacttcagttttcattctccccttagcagctttcaaatatgtacgtaacacaaatgttacatgtttgagcatttaaactgaatttggacagggcttctatttccagaaccttctaactctatttctttgtgacctgatagtcttgctctccagggtaaaagaagaggatggaaatggctgtggggcgcctgagctgggccctggcatgatggcaagatgccgttctgggttcactgggatggctcaaggggagtttggaaaccctcctaacatgtcatctgaaatctgggaccacagttccggctgga

SEQ ID NO: 10296 - DNA, 1164 bp, Homo sapiens
ctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttcacatacagcgagaaggattaagaggtactgtattgttggttgataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaaccctcagttgtaatggaggcatcaagactataagacccaagaccttaacttttgtgctccttgtcttgtggagggaacatccatcctcaaaacagaaacctgtgagatccct

SEQ ID NO: 10297 - DNA, 1149 bp, Homo sapiens
gcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctcttgaagaagatgggagttaggagaagtgaatcttttgttttcgaagcctttgtccttgtgagtctcttaattggggtgtcttgtaatgcaaagtctttaaagatgtgtgttcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctcttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgt

SEQ ID NO: 10298 - DNA, 1308 bp, Homo sapiens
tgtcctaactgagcattactgtaacatagaacagctgaaacactcctcaaagctgagaggagggtttgggagagaagcaggctgtggttgtgaacaggtgcctcctccaaaaaaattctcttccttggatttcaaaatgacccccgttgacaacaaagcctttcacgctgtgtttattttttttcaggtctaagtttcccccaggagattttttttttctaaaggaaaaggcagagaagcccccagaccggagccacaatcaaatgcaaatatgacaataggacccatcctggagagaaaaagccttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctcgtggttaacccaagcaagaggtagttaaacggccccgcagattgccagtgactccgggaatgcctaggtttatgtatggattaacacagtgatagaccctgagtagcaaaagacgaagactaattacctgacagagctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgcagacacggaaaaaaggattattcctccccttttatcaagagccgtaagtccttggaaaatgcaaagagggggaaaaagaagaaaaacagcaacgagtttattggagagttaacacttaaatactccagtacattgagtgtgacatgcctgtgtaggagactgtctgtcccccaaataattgacaatttctctccatctaacaagaaaatatatggcacttttatatatacttgaattggaatccctaatccagagataatttgtgaatatccattctatagcatcccatgttgtcaagaaggtgttgacttactgcaaggttaaggaaatgggtggagaatgtagggaggaggtggaggataaaggataggactaggaatcagagttgggatttgaacccagg

SEQ ID NO: 10299 - DNA, 1458 bp, Homo sapiens
taaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagctcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattatgaggattattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctgggtgacagagcgagactccgtctcaaaaaaaaaaaaaaaaaaaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcatataagtaaattatatgattggacccaggcataaaacgtgatttgactcccccttgcccatcacagttctggagttcacatatcatttgttactttgaaaaatgaacttttgtt

SEQ ID NO: 10300 - DNA, 1135 bp, Homo sapiens
ttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagagaaacacaacattgagtgaggtctagggtgaataccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagatcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattgg

SEQ ID NO: 10301 - DNA, 1142 bp, Homo sapiens
tggggtgacctgtgtgccatgcatcacacacagactactgtttaaccacctacatcataggtagatcctgcattttacaaatgaggaaacagagctcgagagaagttcaatcctcttccctacagagaggaaaggggaaaaaaatggactttcaagacagctgaaattcaaaacaaaacaatgttttaaaattgaatacagccttttgcattaaaattaccattttaataatagtttaaaagagagaaagagagagacccaaaatagtcaaactgaggttttgggttctggtgatagaatattaaatcataatgaagcatttaatgttttgttgttgttacaattgttgttttaccctagggctatgcaaagtagtttaaggatgtatttatttcagtggggaaaaaaagtggaggatatacatttggaggataaggaagcatgaattagggtggaggaagtgttttctggtctagctaaggaggaaaaattatagacctcaaaataggtgtcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctccccccaacaatcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcc

SEQ ID NO: 10302 - DNA, 1117 bp, Homo sapiens
ccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccagttgcagtctttggatgttttaattatataaaaaaagcatggaaactgggcattttaattagcaagtacagccttgacacaaataaaggcatggctttggttatgcagtgcatttatttggttttcttgaaataagaaaaaaagatttcttctccatcaccagagttgctgagtttgacagtgtgaatgagatgacctctaaggcctctacttatagatctgcacggttgggcctgggagctgtactacctcagctggtgggtgataacttactcacagtctgtgctgtgtcctgcactgtccattatctgcaggggtggtactgctgtccccagggaagagaatgctgtccacaaagagccagccatttatactattaaaagaatacacaggagttgaacaatgagaacacgtggacaacgggaggggggaacatcacacaccggggcctgtctgggggtagggggaaaggggagggagagcattaggacacatatctaatgcatgcggggcttaaaacctagatgacgggttgataggtgcagcaaaccaccatggcacatgtacacctatgtaacaaggctgcatgttctgcacatgtatcccagaacttaaagtgaaaggaaaaaaaaaagtttcatcaaaaaaaaaaaaagaaaaagaaaacaccggaaaaaagagactctcttccttgaaggatttaattccaggaattggagaatgtcttgtacatttcgagaaggcaatatagaaaatgcagtgggtagcccaggactcctggtccag

SEQ ID NO: 10303 - DNA, 1140 bp, Homo sapiens
acttagtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaaactcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcagattttgctgggctgggccagttcagctcagcaaggattgctgggcatgtgcttgaaggagaaaggtgaggatacaaaggcaatgagtacatgatccttgaccttgagaaacctatagtctaatagaggaggcacatataaaagtaattaggtaaaatatagtgcagaatatgcagtcatggagtcatctacagatctgcctggaatacagagggacaagtgtttagtattttccaactgttcacagaggacaagacacttgggcagaagtttgaaggcaattccaggttagcagtacccacttgatatggtttagctgtgtctccacccaagtctcatcttgaactttagctcccataatccccacgccacatgggagggatttgaatcgtgggaggtaattggatcatgggggtgggtctttcccatgctgttgttatgatagtgaataagtcccatgagatctgatggttttataaagggcagttcccctgcacaaactctcttgcctgctgccatttaagacatgtgtttgctccacattggccttctgccgtgattgtgagactttcccagccatgtggaactgtgagtccgttaaacctctttcctttataaattactcagtctcaggtatgtctttattagcagcatgagaacaaactaatacaccacttgaattgctggtacgtctgaggggcttgactcccagtccttcgaacatggaggggta

SEQ ID NO: 10304 - DNA, 1232 bp, Homo sapiens
tttggtgccaattttttcattagaatataatgctcttatattgttggagagcaggttaatcttttttcgaagtaattgcgtttgaagtataatttcaaaatgtattgaatttgtgaataagccttaccattaggatcagtaaatttttcaactttgcaactacataagtagtttaagatctccccgtaaattctcactgtgtggcagttgatggagtttgtgaacagagccttaagcttgttgcaaaaaaatttaaaaagggtaatacgggttgtttcctccatgcaacgtaagccatgctgatggactgaatgcagtctgtaattcatggctaatccgaagagtttgattgagttgatggcggcagggaccagatagacaccttggtgattgtctttggccataagaatagaccaaggataggttttccagagacaccttcatactgtaaacatggtttagacacggtcatagggaaggctgctggtccatcatttgttctgaacaaatggcatttcctgctcctgaccctggcagttggccccagattccttgtcgatgacttggaaacgtccattctgggtaaggtcagcactccctgagagatgttaacaaagtttacctatgagtcttactgtgtagacaatctgaagtcaattttagttacacaatcagcattcccatgtgtcctcagtgtcttatcaatgaactatgtgtatcaagccatactaaactggagtttagcaggacaaaggcaaactaaatgtagaacataacatatcagctgaatatgtctatccaggactgtttttctagaacataaatcatggagctccttgacagtgtatccactgtttttggggtttaataaaaccaactagaatttagacttaaaaagaaattattattccttttggttgtccacataaagtagtccagggctatcatatggctaaaatcaagttatttggttcatctctggtatgtatttataaagtcaacttatcagccattaagatggagatttgctttaaatttttgcagtgtgtgtggcagtcagaaaaacccatatctagttttcaacttcacctctggtgtttttatggcttaaccttatatcattgatccaacatctagcctgatgctggagctcttatttctagcctgatgctggagctcttatatctagcctgatgctggagctcttgaagctgactcttggaagtttggag

SEQ ID NO: 10305 - DNA, 1055 bp, Homo sapiens
ttccaccccagggccccctctctgtctatgggatcctttctcccctctctctaccattttcccgtaccttcccccataagtcactcccaagagcctgggcaggtctttgaggaattgcggctcattttggcagccccgtcctgcaattacctttgggtttgaaagaatagctgtgggtgggcaattgaggacacctctttagtcagggacctttctagcaatccactccctcccatcctgttagccatgcagtggaactctccttccctctctgccccaaccccggtgatggctcactctcagcatcttatgggaccatctgagttaacaaccctgttccaagaagactttgtgcagaacttttgttagggtggtcataccttctcaccaccatttggaagacacagcctaatgctgatgtacttaatgtgccccttccggcatagaaataatgtctgggtaacagccatcaaaatcactaagaatgacattggatagctatgagaaagtagtagagaattgatttaaaatatcattcttgtttggtatagattaaactaggaaatgttctctctgaagcatgaaaatgtttttcccatgtgaagtttagtacaaggatggaaaaataataatcacagtagactttgaacaatgcaactgtatctctgaatatccacatttaaaaatagccttcactgaatgctgaattgcatttcccattaatttttggttttaaaaattttgtaaactttttttttatttggaatttagtcacatccattaaattttccaatctagtttctgtggaaattttttaacagagagaaacaaatagaaacatcttcaaatcttcctaagtgaatatttaaaatgcagaattgcttatcttctgtttttctgtattcagacacttatatctgttgtatatattagtttagacactctcactaatatacacagtatttaagactctaaatgagatttcttaagtattttattttattctctgtaaatggttttgtataatctttaaacatctacactttgcctttgta

SEQ ID NO: 10306 - DNA, 1201 bp, Homo sapiens
gcacctgcaggccgtgcggggtatgagctggaggaaagatgagcaaggatgtataataattaaattgagtcatctagagatggcttacatccctcacttgggctgtgcatggattttttccacatcttgtaaagggctaaataagcaaatgccagaacaagatttgcagagatttaccaaggattgagtgactccaggccaggcttccagatctgcagccagtgaccacactgcctccttattagcactcttctgccttctccggggatggtgctggagggctttggctatgataagtgtttttctccttgctctggactcttgcttgtactcaggggaggctccctgcacaggcagaagcagattccctggcctctaccctcagggggtcaggcctctggctgtcttgcagtctgaaagccccaggcttacaggatagacacttaacatccctgcaaattcatctctgccggcagatcatgaaagaagtccggcgagcgctctgcaacgcagccacagacgacagcaaactgctgctcctcagcgcagtggggagcgtgttctgcagcggcctggattattcctacctaattggccggttgtccagcgaccggcgaaaggagagcactcggattgcagaagccatcaggtgagctgtgctccttttcacacaccctggggtcctgcgtaggattaccaagtaaaaatacaggctgctcagttaaattcgaatttcaaacaaccaggaattttatttttagcataagtatatcctgtgcaatactcgaggtctgcttacatttttaaaatgttggttatttatctgaaattcaaattttaattgggcatcctatattttcatctctaaccatggtcctgccaaaattagggatgctttgccctctaggttagatcccactttcattcttttgatcggaaagattttttatttgctatcaaggcctgagtctggtagtggccatgtgttgtccacactactcccgccccttgcctgatggggagagtctctggttgtctggttgtttgtatgtcccagcactgccgtagctcagcagtggggaggttgatggaggggttccctgggcagctgtgtgtttgcagacccaacggggtacagagtatttccccctttctaattgcccctgggcaaaagttgggatcctggcggtgacatccagtc

SEQ ID NO: 10307 - DNA, 1125 bp, Homo sapiens
ataaaccagccttcttgaaccctcctgccagtgttggcttctggcattgaatggctcgtggctcaccccctggctagggtagatgcctctatcccaaaggctttatggtgttcttgttgcctcgaactgagttttttcctccctctctctctgttttctgaccctctcatcttgtatcgcaggttgaaaggattgtagacaagaggaagaacaagaaaggaaaatgggagtatcttatccgatggaaaggctacgggagcaccgaggacacgtgggagccggagcaccacctcttgcactgtgaggagtttattgatgaattcaatgggttgcacatgtccaaggacaagaggatcaagtcagggaagcagtccagtacctccaagctgctgcgtgacagtcgaggcccgtcggttgagaaactgtcccacagaccttcagatcctggaaagagcaaggggacctcccataaacggaagcgaattaaccctcccctggccaagccaaaaaaagggtattcaggcaagccctcttcaggaggtgacagggccaccaagacggtgtcttacaggactacccccagtggtttgcaaataatgcccctgaaaaagtctcagaacgggatggaaaatggggacgccggctctgagaaggatgagaggcactttggaaatgggtcccatcagcctggcttggatttgaatgatcatgttggagagcaagatatgggtgaatgtgacgtgaatcacgctacactggcggagaacgggctcggtttgtagcttttctttctcttgggtttggctctggccatggcgaaaggggagctctgcctgtagcctagggacatacataagacccccacctccatccccgtctcttagctagccagcaattcccccttcatctctctcacctagagctttgtggactcggtcgtaggcccatgttggttacagaccctcatgcatgtggggaggctaagcctctgatgctccagccaaggtctggaatgggtccaaagttccagactcttatttcaagacacccaaggccatggtaacccctctagacccacttccctgagggcagctcaagtcctcacccccaggacccaagacacgt

SEQ ID NO: 10308 - DNA, 1131 bp, Homo sapiens
ttctccttctgctctgcttgtggaaatcctccttgccctctaagggccaactcccgagtcttctcttctatggggactgaatcctccagccaagaataattttccctcctgtgaactcaaccctttgtatgttggaagcttagggcaccaggtatgctcatgagtagggccgtagtctgtctcctggcatggattataaaattgaagagtgcatggactgtggttaatccatccttgaattccagctcctagccctgtacaaagaaggagcacagtatcttggagagtcagtgtggtgttttgaaaagggcctggttttcggatgtctgtcagtttcttcctctgtaaccttgggcaactttgactttttggatcctcagttttctaatctgtaaaataggcctaagaaaactaggcttagttatgttctgacaattacagatacaatatacatgcagcttgtgtgcccattccgttgttgatgactttgccgttgttggctcgataaggtgtctcatccagaggagctgggaagtgtttgggagatcagggtgagttcctgggtaaattctcaggactcagcagtgtgtttgctttcattgactctaagacactacagattataagatgctctgttattttatgtacctctgaataatagaatcacctagtgagctttcacatgtcttggtgcccagccctgctccagatcaataacatcagtaatctggggggtggacattggttttttcattcacttatttattcattttattcattttcttcttttttttaaatcagtatttaaaaacctctttgggtgattctattttgcagccaatattaagaatcattgtacttttaaaagaaacacctctattatatgactcaatgcttccttatcactgggaatttttattttaatttgtttatagagcccttttagacattctctcagctcctgaggggtccataaccacttcttcctcaaagaagggtctcctgagaattttgtaacagctaacagacaccagaactgggtagtggctaggacctcttcgtcgctgtgcctggaatacagtccctgaatttgcagcccagcaggttcagtgagtttggggagaggtggac

SEQ ID NO: 10309 - DNA, 1083 bp, Homo sapiens
tgcgaaagaatggatttatcttgtctgggttgaacatgacctctgctatagatgggggaaatggcatttgtaagtgaggatagagtgtcatggtcgaagaaagttgtattttaaggttttctttttgctctgtcattgttttcagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataa

SEQ ID NO: 10310 - DNA, 2855 bp, Homo sapiens
gttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtacagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacgtaagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaagtcgccagcaacaagcacgtagtgtagtgttcctgctaaatgagcgtaggttatccaaaccttgggaacagggagttatggaaacatgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacgacatgctcctttctgtggcacatgcctgtattactgaaagctaaatcctcaaaacctagtaaggggactaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttatttaataatacccagttattttcattgttttttcttttgttcatgaaaatatgctaacagacaattttcctagaaaagacactccaggtaataccagccagatggctgactagaggtccctaatgcttgttgcccccacagaaaaggaccaaaacaacaaatagaatacattttgactagagtatctaaaagaaaatgaggcctggcatggtggctcgtgcctgtaatcccagcactttgggaggctgaggcgggtggatcacctgaggtcagaagttcgagac

SEQ ID NO: 10311 - DNA, 1248 bp, Homo sapiens
cttctgcactccacacgtggtcgcctccatcctccctagtgtctgtcagcttgcctggtcaccaagtcaggaggaagaagatgaggaggctcaccagttgtaggcaagactcttcctctcgggagatcttgtaataatggcccagtttcagggcacagttgtacacattctacttaaatggaggagttcagtgatgccgtggccaaaagagttatgcccatttctaaaagcctggcatatttggtataacttaagcaccaggtaaaatctggtgcttaagttgtaccaagtatagccaagtttaactgtcgttgtgtattaataagatttaatttttatgcttgtgcttttcagagtaaagggcttgctttcaatagtagaatgacaaagcttctcctccaatgacaatctgttagcaccctgttgacttagctcaggacatgagactgacttagctcaggacatgagacatttcctggaagtgatttccatgagaacaaaggcttattcctttaacttaaaccccaaactttgttattttaattattttcaggcaatcatctttatatactttccttacaaacccagtggttgagagcataggccttggtggcaggtgcatctgggcttgggggcttctgccacacttactactctgtgacttgggaagctcttaaggctcccaaggctccgtttcttatgtggaagaagaatagcaggaggactcacctctgcgggttgttgtgaggattaactgggtgatgactgtaagcagctgggagagtgccttgtgtgcagtgaccactgttgctgccaccatgattatgtcacctctcaacatggggtggtgggaggccctgtggatgaggccaaggctgcctgcactgagtgtcccaggccttatagctttccacattctcacgtctgctgccacatgatatacaagtaaatgtattagaagttggtgttcataaaatacttttttttttttttttttttgagatggagtctcgctccgtcacccaggctggagtgcagtggcgccatctcccaggctcaagggatcctcctgcctcggcctgccaagtagctgggactacaagtgcacaccagtatgcccagctaattttttgtatttttagaacaggtgtggtttcaccatattgcccaggctggtctcgagctcctgagctcaggcaatccgcctgcctcaacctcccaaagtgctgggattacaggtgtgagcat

SEQ ID NO: 10312 - DNA, 1242 bp, Homo sapiens
ccgtgggagtatcagagccaccaggccagttctgtttgaacatttccctgaatgtcttggaggatgggatggggagggatgaggagggccttctttggggtcctcctgtctgctgcacccttgaccttgtctggtgtctgacagcagcagcaggtaaagagcaggcctcagtgatctcctgcatttcctctggccctcactgggagctcttgccttgcctgacagttcaccaagtactgtgtactatcttgtgcagaaatcatgagcaggaggaagaacaaaccacttcctctacaaccttcagatttatcagacacaacttttgacagtttcagtttaaagagaatttcaaaagaagatgttgaaagcaatagggaaataaagcggcccctggcctcagctctctgctgcttccacatttgagacaaaggcgccgcagggatgctgggagagagccccagcggttcaagaggtgccccatccaggcgccccgtccaggcagcttgggtccagagccttctttgcacgtgcagcctgctggctgtggtggctggggttctgggcatctgcagggtgcttttcatgtcctgggagtagtggcgtttgcacagaggccgggtcacagagacagatgtttcagaagtttgacctcaaaacagctttcttttcccttgggttgtctggagaaagtgctaaaaataaggctggatctgagcaggcgctgctgacaggccacctggaggttcgagtccaccacgaaggtggagtcttggggttatactggctggagccataggaaattgagatttaaaaaagctattaaaaagattataaatgagatcttgctgtgtttcccaggctggtcttgagctcttgagctcaagggatcctcccaccttggtctcccatactgctgggattacgagcatgagccactgtgcccagccaaaattgggattttgtaagtagaaaatgattaaatattggttccatatagtttgtaagtaaacacaattcttgacttcctcatgtgatctcttcgctgtagccctgaaactcctgagatcagtacaaaaagaaatcctttcttgggaaagaaaagggagtgttatgattggtgtacatacacataggcacacacatatgcatacacacatgcacacaggcacaaacgtgcatacacacatgcacacaggcacacatgtgcgcacaaacatgtgcatacacacatgcacacaggca

SEQ ID NO: 10313 - DNA, 1318 bp, Homo sapiens
cttggacgcttgtgttggaatggggtgatctcaaatctcactcatgattttcgacccctgtaggacttgggcctgcctttgggggacgcggggacgcagggacgcattgagcagaagctgcaagcggatgacccatgggccaagtcaagtctgctgacgtgttttacttggcccacacagtggttttttttttttttttttttcttaaagcttcagtaagttgtctgcctttaaagttgggagcattcccctaaaaagttccggatatccattttctaataataacaacagaagcaaacatttctatgtgacttaccacaggcctggctcagctctagacgactcccatccctttgctcctgggatccccagacagttccgaggtggtgcttcctgtgatcatccccattctacagctaaagaagcagaggcaggcctttaaccgggcactcctggctgtgcccatgttcctgtgtggccaccccttcaggctgggcacggcctctccactcccccagcctcctagcccactgtactcaggttcccccctgctcagagcttgtgggcgtggactttgtaccccccgggcttggagagggcaaggtgactgtgggagtccagctgctgctccttaagttgagttgtctgtcactgacttaccctccctccctctctccctactgtctccattcttctctttcccccttctttctcctgcaccctctttttccattcctcccttcccccttcctttctccgctctctctttccttcactcccttcctcccattcatctggtgcttaccgggggccaccaggtaggcacgtcgcacactacttctgcttcatgtgaggggttcatggtggcttctccctaccttcagaccacacctctggtgggaggtgctgcgtgaggatcccaggggtgaactgagtcaggtcagaggagcagggagccccagcccctggtgtcttcttactgtgtggtctcttccgtgtcaccgcacttctgtggaaggggaatgatgggggaagtggaggaaccactgtccgcctgcggaggggcctcagtgttggccgtgctcatggcgccctcctcctggggctccctctcctctggtcctgcctctcctgcacgcccttcctgcctccttggtgccaggggagccagcccaggacagtctctgtgcctaggccctgccagcctggctgccctgcctccagccatggggggcgggcggggagggagtcgaccagtgcttgtctttgcagaactgctggtggactgaatgtggttctgggggtggccaggcctgag

SEQ ID NO: 10314 - DNA, 1156 bp, Homo sapiens
gactcagtagcttggggctcccctctgctcaggcagacctagggctctgatggctcccatttatgagaacagctgtcacttggaaggacctgctacctgtcctccgagatgtgtttttcataccttgtattggtcctctccaccaataacccctcatggatgagtgattgttactgtgtaggaagaacttggggctcagtgaggttgagccacttttccaagaggccacttagagctggagctcataataagtaggggtctctaggaactgtttctaaacaacccccgaacccagctggtggctcccagaagggtctctggaagcaaggcgactgtctcattgtttcattagtttgagccctacggggccttaggacacagccagcttggagaagtcactctaataacccatcttgccggtgatgcccaggcctcggcagactggctctccgagggtgtctgggcctgggcagccgaggtcttgttaaccccaaatcccacaggactcgcatagagtgcagaatcccggttttctgaattggtgctaaaggctcagtggcctggccctgctgtgaagccacagggcttgtgctctgggagccttggccgacacaggtgccccgccgcctcctctgctgctgcagcctcaagggctacaaagaaagctccttctgcccgtgcagcgtgggctcctgggtcccctgcaggccaccatggctgctgctccagctgtggtccccccagaggcttctccaggcagtgcctgccgactctccggtgcttcccttattttattcctcttccgggcactaagtttcggtttccttttcattgttctttgttggtctgttcattcattcatgcatgcatgtgttggttcattcattcattctcagagtaccatggtggctctgaggacagaggtcagacccagctgggttggaacctgctgctccctagcagtgggcctctgggcagatgttttaaccatagaactcggcttccttgtctgaaaacgtggctccttctaggacagtcaagaaggttcaatgaaatgatggatgtggagccccaggacgtgacctgaggatggtgcttgtcatgttggggtctgtgtccctcccttgggcacattctctccttccttcctttccag

SEQ ID NO: 10315 - DNA, 1159 bp, Homo sapiens
ccccaacacggaagcctgtaagcacactccagggaccagggtggagtgagctgcccctggctacagagctgggaggtggaggtcctaggtttgcaccatgtgcctgggtcaccgagccttcccttgcactcccctgtccctggccagggcttcctcaactctacataagggccagccttgggctttgggacattcaagacacccccacccccaccttctgggtaaaggtctttcctgagcctcagaaatgacgcattacagtggcttcccaaactgcgaaggaagaagtggcgtttgtgggttgtcatcgtttctttgggcaaggaaggggggacccgagcgttcgtgtgtcatccagcgcaggctttgatgaggctgatgagtcatggagccatacaaggaagtttttcatgtaaacggtttgtgggtgaacttgttttttgccctttaaggcagaattttgtttttctttttctcgccctttaaagacaagtttttaaaacgtaaatgagaggcagcgtcttgatgagcaagatcttttgttctgcaggcgtctgcagtgtgtctctttcacagccagtggtgggcagtggaggcccctgagctgggttgctgatctgcacttggggcacaccttggccaggtgtccagcctggaagagggaggtggcctgccattcttttgttggcctccagggctcccacctgctggcctgttggctcggagatgaggccaaacagagactttaaaaagagcagtgcttgtccccacagaggaattaggcccttgcttcaccgagggatcatcagaaaatacccagcgggacagccggctaactctggaagggaaggtgtttgggagagaggataattgaccgggagatgatgcagaacgactagggccctgagggctgttgcccacattctgctcgccggagcaccctggtgcactttcagaaccaacagactgttttgcagaaagccttgagagggacagagaccccctttcagagaaactgaggccactcctaatggagcttgctggcacgtggcagcagaaggccagggtggtttgtttccagcgggggctggcacatgcttggaccattccctttggaaaactgggctgaacctgacctctgtccaggagtacaaggacc

SEQ ID NO: 10316 - DNA, 1199 bp, Homo sapiens
ggattggagggcagttagactgcaggaagctactaaaagcaaaacagtagatcccattggcttatcaagaaagtggccagtggcattttggtggaggagaatgccaagagccttatggctgtcacgtgaagatcagcatccactcagtcggtcagcaaatattttttgagcacctgttatgtgctggggtgatagcatgggctgtagagacaggcaacctgggttgggctgccatccccacctcttcctgtctagaccttgggcaagccgtgcacccaggctgagcctcagtttcctcatttgtagcacaggaatgatgatagtattacattttggcctcatcctgggattcagggaggcctttagtctgatgggtcatggtgcatcatgaacggtgcctgtactcatgtgccctctcccgcctcttcccccagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtgagtgccccccccgcgtgcccgcccccggggccggtgggaggagactgggctttgctgctgggtgcggctgtgtttgttggttcgagctacgcagggccgggcatggtagagtggcttgtgtgtgagtgcacacgagctggtgtgtgcaagagtgtgcataagcacaagtgtggctgtgagtacaggcatacagggtgcatatgtacaagtgggtgaggcacatgtggctctggttgtgtatctgtgagcatatggtgtgtgtatatacacacgtggggtgcatgcatggctttgtacctgtatgcttgagtgcctgggcacatgtgcaaggtgcatgcccaagcatacatgtgtacatatgtctacatgagtttgtgtgtgtgtgtgaggatctggatacatctgcca

SEQ ID NO: 10317 - DNA, 1471 bp, Homo sapiens
cccaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttg

SEQ ID NO: 10318 - DNA, 1236 bp, Homo sapiens
tggaaggctgatgtaactactatgcccccaggctgcttcatactaacaaacgtaaagagctatcatagggcaggagctggcaaaccatgacctatggaccaaatatagctgaccacttgtttttataaacaaaatattgttggaatacaaccatgcccatttgcctacggatcatctgtggctgcttttgcaacacaacagcggagttgagtggttgcgacagacaccgtatggctcagagagcccaaaatatttacctctggctctctgcagagaacatttgctgacccctggcagagggccatgtgcagaatgaggcctcaacatgtggtggtcgattgcaagtgaattcggaattggttgatgtttcagtcttcgattgcgactggatggaccctgggaaatgaagaattttatcagttctcactttgctgatctctcgttctctttgtcattttaaggagcattgggctcaggatctgaacaaagtccgtgagcggatgacaaagttcattgatgacaccatgcgtgaaactgctgagcctttcttgtttgtggatgaggtgagtaggctgggcttgttgtcgcttgggggtgactttttgattgatgtctgtgctttctgaggtttattttctgtttgtctttccttggagaactttgctgtatgatgttgcctcgactgactggttagctgggattgtttcttttcttttcttttcttttttctcccaggttctagattactgtaactgtaactgcccagtgggttcattttgcctgctgcctagacagaaccgattgatcaaggcaggggaattgcaatagggaaagagcttaactcacttagagccagctgaatgggagactggagttttattattactcaaatcatcctccctttcagaggctggagtttcgtttttttatgtttttgtttgtttgcttgtgtgtttgtttttgagatggagtctcagtctgtcacccagcctggagtgcagtggtgggatctcacctcactgcaacctccgcctcccaggttcaagtgattctcgtgcctcagcctcccgagtagctgggattataggcgctgtccaccatgtctggctaattttttttgtatttttagtagacagggtttcactatgttggccaggctggtgtcgacttcctgacccttgtgatcagcccgcctcagcttcccaaagtactgggattataggtgtgagccaccgc

SEQ ID NO: 10319 - DNA, 1116 bp, Homo sapiens
ccaggtgctttaaccagtgaggttcaagatgctttcctgctctctaaagtgcctgattggccttagatggaggccggtgctctggcttggtcccatgctttcctgttgccctctcctccagctgtggtcatctttcccgctgtttatttctgcagcccccagggcctcatggctctcagacttcccatagaacagaatggagggctttgctgggaaccgttcactgcatgtctcaggatgccaggaggccaccataaatgagggctctcaggagtgggaggcaggcagaggagggtagcaggtgctgttttcccataccccttcgggtggggaccagctgaggctggcctctctatgttatctggtaccctgggtcagggtgagacagaaggacctgtctagtgatgctggggtttggtccaaggctttcagaaacccctcctctctttgcggcccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggtaatgcccccgacccagggaacgcctaccttcttctccatgccaaccgatgaggcagggtggcgagtggttctagctcaggcaggaattgggcaggctgggacctgaatcccaggcttcatttgtctagctcttctaggccgggacaagggtgaggtgggtatgactcacttcggcactgtaacccagattaatgagatttcagggcaatcttttaaaaaatcaaaagtaatgcaaaaaagtctgtgatgaacaaaatatgaacattttaaacaaagacaagatctgaccctactcttagatgatgtggtctcactcactttccccgatcccagccctggagtgggtcatgtggctctggatgattcagccaaccttctagcatctctgtctcctccataaaacgaggactctagggctgtccttttgaagccgtcataggctgtgatgagcttgtgcattcattcatccacccacttatc

SEQ ID NO: 10320 - DNA, 1168 bp, Homo sapiens
atcctaatagtagccaccaacgagaaactgtgctgcctcccttactcacattattctcattgaatcttcatgtcagcctgcagagtagctcttactctgttttaccattgaggagatttaacctctctgagtctcaacgtcttaccaggaacttggagtctgcctctctgacactcagccctataccatccagctatgaatgactggcaaatgtacagaaagagaaatgttacagagttcagcacgcagcccatttctcatggcccactgctgatggtgaaatctgttttatttcaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttgatcaattaagccttctgttgcacgacctgtgcagtgaacaggatttcttttctggccaagaagattctacctctaatgatccaggtaactgatgtccatggaggatgagctggaaatgtaagaaactattcatgagattctgaaaaggattttaactcaaaggcaaatgattccataagggcccaaagagaagccctacccacaggcagcctgctcagttcaatgtactttaactaccaccggctgcctgctgcagtccacaagaaaatggctgagtgatgggatctgttcattaagacaatttctaattaatggtgacagcttgttttgtgactagagttactgggatggagggtaggaatcttggggcctctttgttttaaaaagcccatcagagagaccagagccgtgctgcaggggcaggttctcacttgcccctggctctgccagctgctgggaggctctggccccactagtccctcatggccctactgaactggctgggaggctgctggaatggcccttggtccaca

SEQ ID NO: 10321 - DNA, 2128 bp, Homo sapiens
ccacattttaagtcactgtgaaatacagatttgggatgttgaagacagactctaaaatttgcttttatcttcacagtaggtggggttcattcactgtgtgagtaaatcacataactgctttctatgggttatgtcatcgttattcttatccagagataatttggaaaaatgtcctaccagtctcagatgcttctgtgggtctctttttatattatgtggcaatcaaaactgccatcaactgactgattatcttaccacaagaatttcaggatggtagactggctagtgatgggggtcattcaaagaaaagagtgggagtaggaaactgactctgaaacttttaaagatatttccagttaaatctattgctaaaatattgccagaagaaaataagtttaactcagtaggagagtggaaagggatttgtagttgataggtctatatgtcatttttacttgtgctcatataatgaaaaacatgttgatgatttttccttcttcaacaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgctatgaagcttcctttgtgtcaaaaatctgtttggttttcagatggaaatgca

SEQ ID NO: 10322 - DNA, 1161 bp, Homo sapiens
aattgcttgaacccgggaggcagaagttgcagtgagccaagatcgcgccactgcactccagcctgggtgacagagcgagaccccatctcaaaaaaaaaaaaaatagtgctggtgaatcagtccccgtgggaactggttacagtgaaaggtctgactccactacagtgcagagtaggtgggacatcctgcattgcaaacaagctcctgcaggacccaaacagctcctgtgaatagcaaggtcttagcgcacaggtgtcaacattgggcctgggaggctttaaaaatgctgaaatcagagtgggcctcacagcagctgattcagtcaccctggggtgtggcccgggctgaggaggttttgaaagctctccaggcgatggtgttggaaggggcggaaagctgccttcgagcctcagcctggcaagcagcacctgccagccagaccttgaggaaaggggagcagctctgtcccacggattcagatgtcactggaaaggcagaacgaggaggcacctggtcttgtaggttcaggccagccttggagctgccctccacccatccctgcctaatgcagccggaacttcgtctgcggctgcttttctgaactcttggcgtcctgtttctcctcctgcaccccaaaattaacgcagtcctgcccgtggctggcattgtcaccaggccttgcaaacacctctgtcggactttgcccaacctccctggaaacacaccaggggttttggaaggactgcagtggtaaaggttgtggcgctccctgggacactgattcggagtgtggttgtgtgcagctgagcgtttggcggtgggtgaagccacgtggactgatgactgtggacctacacctgcagggatggccgtgggcctgcgtgtgtgtgtcagcgtggctgggagcaggctggtggtactggcagccgcttccacgtgggtgaggggagggcctctgtctgcaacatccctcatcagttccccctggatcccagcccggggagggggagagggaaggggggctcagcttcccaggaccctaagctgctcctgggagaagagaaggatcccagtatccggtcagaggctgcaggaagcgcttgcctctccctggcccagggctgactccgcctctcttttctgcagattttccgccgtgcg

SEQ ID NO: 10323 - DNA, 1176 bp, Homo sapiens
tttgtggtacaaatcaacaaggccaagagcaggccgaagcggaggaagcccagggtgaagcgcccgcagctcatgcagcaggttcacccgccaaagaccccttcggtgtgaccggcagcctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagcttaaagatactgtgtaacggactctttccacttgtcccatttctctttgatgacggtctggaatgggttctgaatcaacctgctaattttgtgttcactgagacgtaattcacataacattctccactttatagtgtagagcgcagtggtttttggtgtattcacaaggctgtgcaggttccggaacatttccatcaccctagagcaaaaccccactcccaccagcagtcacccgcgttcatcacctgcccctaggctgctggcggccgggctgctctgtggatcggcctgttctggacatgtcctttcaatgggatcgcacagtacgagtgggtccttggcgtccaactcttttcactcagtgtcgtcttttcagggttcatt

SEQ ID NO: 10324 - DNA, 1126 bp, Homo sapiens
aaatatgtggacatacttttaaaaattagttacatttgtcctagcttttcataataaaacgtgaaacctgggtattagtatatatgactgtattcatagagaaacctgtgtgtttagcaagatctgctggctgccctttgtgtaggtgtctgaaaacataggcctttcaggataataagaggggacacaatttaggttttttttttaagatagaggcagcacctttgcaattgtaaatattatgtactgccatggcaagtaaaaatgaaagtggatagatacggaaatacacacaaagtgaattttgctaaaacaaatcaatggcacttaagacatttctattctaaaaggcttattcttaaggcttttctattctaaaaatttgcaatgttttaattgaatattagattttgtaaatgtggtttatttgtcacgtggatgaaatatcaggaaataactcactgctcagtggaaactctcatggctgttgttttttgttgtgttgtttcaggattggaggttttaaagcaggaaacagcagttgttgaaaacgtccccattttgggactttatcagattccagctgagggtggaggccggattgtactgtatggggactccaattgcttggatgacagtcaccgacagaagggtaggaaaaacgcagatggactttgtgacttcggcactcagatcctttcttccctttgtctctggaaaggcgcccgtgagatgctggcagatcagccgacatctgttcacttgagccaggctcagctggagatgttgcagtcactttgattgcttggaatattttgataggtgtctgagtgtgcacacatttaataagcaaaacaaagctacttgttggggccatgatgcctcttctccatcttcaccttcctgaggccagcggaggcgggactcccgcgttgtggtggagagtcccttccctgacttccttggggcctgcccctcccaggcttcctacgccgtgctgcctggactttgtgggcactgccacgagggggcgcccttctctggtctgactcactcttttactggagggctggctcttggctgtccttccagacctggaattcgggcttttcttagcctttatcag

SEQ ID NO: 10325 - DNA, 1104 bp, Homo sapiens
aattaatttacttatatttatagtaattaatttactcaaagggaataatgtccttccctttattgggatcaaggactcccaatgtattataaacataatcacctttatgttttgaatcggtttctttagaatctgtgactgaacatttctatgcttctttctcatctccttctccttcactgaaccttgctgggtctaggctaagcagttatctctggtgcatttcggtaaagtactgattttcatttcataaaataaattttgctttaattaattctacacatcagccgaagcacttaaatttgcagttttacccaaacccagacagttggtttcagttgaagccttagtgtggaaggactggattgtggcaggagaaattgagttttgtcacagagactaaataactgtgtatggagtgtcttcattccctgttccctgtgtgtctgttaccactttcccaggcagtggtggatgccggataccggaggagctaacatcccagctctgaatgagctgctgtctgtgtggaacatggggttcagcgatggcctgtatgaaggggagttcaccctggccaaccatgacagtaaggctctgtttcctgagggcgtggtcttaggtgtgagagcagaagctctacacctctgaagtctagatttcttgagaaagagaatggtgatccctcagttagctggagtctgtggaaagaactcaccagtattttcaaaagtacatctgtgaggctctagttttgtccagattttttttaaatgaaaatattttatgtagccattcctaattttagtgccacctattagagtctttatgtagtagtcccaaataggaactacctcacagcttcttaattatttacaaagtgctattcatgaaataactttgtgtttcccgtgtaggaagttcccccacaggtaaggttttggtagctggttttgagaacaacgtcgtaagcattcttactacccattctgcaggtctggacagcttgttttgagcctttcactgctctgagttataacatctattcagaaacctaatgttaatagtatttttctttgattataaaatgtattcagaaacctg

SEQ ID NO: 10326 - DNA, 1134 bp, Homo sapiens
taaggaacataggagcacttgaacatcagaagactaatactgtgaaataactgttactgctgccatttgtccttcagtctgtttaggaatgaagaaggttagatagataagttgaactattccaaaatgcttaacttaatagaagtgccttgggataagtccttttgtaggagaggggcggttgggagcttgggtgttatctaggaaggcattctttgtgtagagagctgtgcatttcacctagagagataggccacctgcagaacacagctgcctcttccttaggttcagctccaaggacttagaacttctacgtgttgtattttactctccagagcattatgcatgctcaggattcatttctggttttaagtaaaaaaaaattaagagaactacttgtaattttaaaagagccttagaaataaaaactgtcctagcactttaaaacttgattgaaacactaagcagactgttataatatttaactaggtatcttacacatcttggtttttggacgccttcaactatgccattttaaagaagatcgacgtgttaaacctcagcatcggcggcccggacttcatggatcatccgtttgttgacaaggtttgtggagtcactgcacacggggtttgggtgacagctcctgctctttcgcagcccaactttgcatcatatctagtgtgttggtggcttttcatccaggtggtgacagctttgtgagaacagatggctaatgacgtgagcttcagtgatttgcatgtcataaattgagtgggttagaggcctcagagtaggtgttgataaggagcacatggtgccttgctgattttttttttttttttttttttgagatggagttttattcttgttggccaggctggagtacaatggcacagtcttggctcactgcaacctccgcctcccaggttcaagcggttctcctgcctcagcctcccaagtagccgggattacaggtgcacaccaccatgcccggctaattttgctatttttagtagagacggggtttcaccgaattggccaggctggtctccaactcctgacctcaggtgatccacccacctcagcctttcaaagtgctgggattacaggcgtgagccaccatgccctgcc

SEQ ID NO: 10327 - DNA, 1146 bp, Homo sapiens
gtgaaattctagcagataagaatattgagaatattgagcaatatacagttgttttaagtcctgttgatatttgatggcttttgcctgcccaagaaatctagtgaaacttatagtaaaaataaaactcaatgaatgcttagggtcattttctttaacttttcccccttctggttcagtgagaacaagttgctgatgaaaatcaggtttttctttatttttattatcacaattagctttttaaaattattattatttaatttaatcagtctttctttgccttaccttggttagaaaatttcaagtagagaactatttgggagtaatatgacagctaaataacgtcctataattataattgcattgagactgtccttccagaaaaagaagataatcccactttccttcaaacagagtggcaaatggtaatcctccctgtgtttaggatagttttgcctggcgggtatcgtgtagttcgttttgctcttctgttctgatctttctctcccttgcctgtagctgaccccacagtaccctgcaatgaaacccggtggagccagaagtggcaatcatcacgtcccctgcgaagagccagcctctccctgggctctggcttctggcatgctacgggaaggcattcgagcagacggctgctgagagccatcccgcgccaggttgcccagacactgcaggcagatgtgctctggcagatgggatatacaggtgtgtgctattacccagggaaggtgcttatgggatatacaggtgtgtgctattacccagggaaggcgcggaaagtccagacatgcaggaattccatgttcgggactgcctagtgctaaagccctgcagccttccacatctaaccttcttactatttgtttagctggaggtagccaagtactcctcatctttgactcctgtgatgccaggcatctgtttctgtggctttcctaattgtcaccatttgtgtcttatttttgttaccatttctgaggttagaagggaaggctgtggagcacttctctcctattgacacatacacaaacgagcacagcgctgccggccactggcgctgaccgacaggcctgcagaagtctgtcacttcttggggaaagatggtccctgatctgggcaattccacggaaa

SEQ ID NO: 10328 - DNA, 1208 bp, Homo sapiens
aaaggatcatcctgatgccttcttctctttggctgctagaatgctcaggtccagtgtgcttaatatttttggtgttattttgttgtccttacttttttccatttttctcattgattttattgttttatttttgaagatgcctaaaaaaaattttcccgtgaaagcagtgagtaataagtaaataaaaatgaaataatatgtttcatggttgtatggcacattaatttgtcttaaaaccaggatatctcttttaccctcttatttattttattattttattattttagacatagggtctcactttgttgctcaggctggactcagactcctgggctcaagtgatcttcccacctcagcctcccaagcagctgatctacaggcacctgccaccttgcctggctgacccacttgcttaaattataaatacaactaaatcatacctggctatgtcagtttgctactaatgtctgtgtgcactgttttttgtttcatagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtgggaagaaacatctgggcgacagactggaaaagaaatcttttgaaaaggccccatgccctggctgttcccacctgactttgaaggtggaattctcatcaacagttgtggaatatggtaatgatgttgtcttaagtattaggaactcccatcctatttttttaaagcttacttaatataaaattagctattgctgaataacatgttcctcttttctacagtaaatttctttcttttttttttttttgagacagagtctcactctgtcacccaggctggagtgcagtggcatgatctcggctcactgtaacctccacctcctggattcaagcaattctcatgcc

SEQ ID NO: 10329 - DNA, 1068 bp, Homo sapiens
tattatttttaatttggggaagaactgattaccttagagagtttttttcatttatttattttttttttttgagacagagtctcgctgtcacccaggcgggactgctgcagtgtcccaatctcagctcactgcaacctctgcctcctgggttcaaacgattatcctgcctcaccctccggagtagttgggattacaggcatgcaccacaatgcccaactaatttttgtatttttttttttgggtcggttggttggtttttagtagatatggggtttcaccatgttggccaggctggtctctaactcctggcctcaagtgatccgccggcctcagcctcctaaagtggaatcacacccaggattacaggtgtgagccaccgcgcctggcctttttttcatttgaaaaccgccaaatcctttcttttcatttcttttaaaggcaagtacctgcctaagttgtaagagaacatcagccatctcttctgcatgggctgtgttaaaatttcttacctaagagtctttacctttgagtgaattattttagaacaggttgaattaaagttgatttaacccagttaggtctaagattttctcagtactattacttaattatatttgtgttatatggagcccacatgtgtcatagattctttagcttgaggcagaaaagttttaagaggcttttttgtttgtttgtttgttttttaagtggagagagagtctcactgtgtcacccaggctggaatgtagtggtgcactcttggcccactgcaaccctccaggctaaagcaatcttcctgagtagctgggactataggcgcgccaccatgcctagctaatttttaatgttttttttgtagagatgaggtttctccacgttgcccaggctggtctcaaacctctgggctcaaatgattgttccttcctttttaacaacaacaacaaaaagcctgccttgagtgagaaacgcatttaataaatatcttttaaatatatattcatttactgtgatatgagaactgttattactggcttttatcttcttcggccagtagtctttaattaagct

SEQ ID NO: 10330 - DNA, 1967 bp, Homo sapiens
ttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggc

SEQ ID NO: 10331 - DNA, 1204 bp, Homo sapiens
aggggaacgtgtcctgcttacccagtacctggggcactccagccccaaatgcctcccccctactcttcatctcgtctgtacccaggtgagtggcacacaacaccgccccgccccacctctgctctgtctcagatggtcactagaggctgctgcttaccagcggctctgctgggcccagacaaccacccagcaaaccaaactcaaccctggatgaatctgtggcccaaacacgcagtggatcccacagtcggtgctaacaggcaggtggggaagctctcccagggcctccccttagtagagcttcgaggtgcagccaggggtggagcaggggaggaggggcctcggggtggggcttccgtgcagagctggagagtttctgctgtgcaggaggcgggggctctgaggaagcaggtctgtcctccacccgccctcccggggacattcgtaggcgtgcctcgagcacaggctcccgggtcaggagagtgggggtggctgcgagaaggccaggcaggtttctgctggcaaggctcccccacacctcttctgagcacccctttcccacttgttctgtctgtccaccggactgtcggtcagaattggtgaaggaagcggcacctgttcagggctggcaggtgaagtctgagaggcacgtggaggctgatgggagatgctgctgcccctcagggctctgcactcacctggagagccacatggggcctggagggccactacacagctcagctcccaagttcggccacatcccccttccttctcgggccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggtgagggtccaggccagggtgggcggcgtgtgggagatggggcggtcggggcctggacagggcctcagctgtctgtccttcctcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtgtgctgggtgggggagtgag

SEQ ID NO: 10332 - DNA, 1769 bp, Homo sapiens
ccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaacagtttggtttctgatttgtcctacaaagttctttttttttttttgctgtaataacagaggcagtcatcatcgccttcagatttaataggtgtttgcggagctgctgaggcggggcacattcacattcaattgcttatttaattcttagcaaccataagaaacaggtgctgcttttgtccccatttcctgaaatctgaggctcagagggattcattcacccgaggtcacccagatagaaagtggcagagctgggattttttttttttttttttttggtgacagagtctcactctgtggcccaggctggagtgcagtggggagatctcagctcactgcaacctccatctcccagattcaagagattctcctgcttcagcctccatagtagctgggattacaggtacccgtcaccatgcctggctaattattgtatttttagtagagatggagtttcgccatgttggccaggctggtctcgagctcctgacctcaggtgatctgcccgt

SEQ ID NO: 10333 - DNA, 1334 bp, Homo sapiens
taattactggtacttagagtttgtagaactgggttcttaactaatagttttctttctaaacaggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcaggtatagttgaaaagatacaaatctagagtgaagatgggagcagacctcatcaactgggcttatagactgtggtgttacccataacaatggcagattacctgtgtgttaatagcaacgtctgaaggatgcctatgtcttaaatgttctctaaaagtaagataatatagaaacaaatgggaggagagggttgtcgtaactttatgttaagtgaaagatccatgtctgttagc

SEQ ID NO: 10334 - DNA, 1874 bp, Homo sapiens
gacatcataatctctgtccaagattcagataatctcttcaggacagtctagaagtagagtcagccacatccaagggcatgagccaggtctgtaggcctgtacagctgatggctgtgtaggagtgtctgtgtgaggcgtgggacattttaaatatgtggttaatatgcgtacatgcacacatgtacctatctgacttacccttaccttgcagttatagaaaagtttttattatggattgcttgcgtgtttgagttgaaatagcattggtttgtgtgatgacatctctctgtcccacctgctttggagaggggttttacacataggatgcatccctggagggaagtcggcggagacctgtaatgattcgtgtgcagtgctgttctcactctgctgcctgctgggctctcttccagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaggtgtgtgcgtgtttctttgaatgcgaatgccttttcgggtaactgaaattcatgggggcatgagtttgcctgcagaattaaaatctgcccttcgatcagctcgacgtgtttgtggaagctgaaccaccactcaggttatgcttgtttagtattttcaaatggattagtgatttgggtacacgaagtttttgactcttcgattggcagaaaggaggaggttttctccccttcccctcctcatcccttgtttctatagcccaccgttttcagtatcaccaaaatagttgctgtaggtcaaggctaaatgctcttcagttgagtgccactggggcggctgagcggtgcctccagacgccaccctcagtagtgggaaggaagccttctgagacggaagacatggagagagggatgtcacgtgcaagggtgcccgtg

SEQ ID NO: 10335 - DNA, 1914 bp, Homo sapiens
ttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctcaaatggcttccaaagcgcccgttcttcctggatggtggtgttttcagggggtgcctttccgtgcttcgtgggcccagccccaggctgttaaggtcactcccaaacagtttccagaaactctaaatgcttttgtgcccatgacaagtgacctggg

SEQ ID NO: 10336 - DNA, 1723 bp, Homo sapiens
gttaagagagcagggctttgcccgtgggagaggcgatgctttgctgtgtagcaggagacctcggtggcactgtggtctggcctgggtccgtggagaagctctgcccatccttgtcagaggtcagaggggcctgtagtcatgtcatggaccaccccacgtcagggcagcccagcctgctcgccagccttggaagggcctgggcgcttgaccactctgtgctggtctggctgagccgagggaggtggcaggcggcgccctggaaccccaagctgtcggcacctagcagcctccggcatcaaggggctttggggctagcagcaggcatggtcttcatccccagccattttgtcacgttccccacgctcaggcaggtgtgtgtacctggctgagacacacctgtcgacagggctgggtcttccccttggttcatttgctgctcacagccccgtcttctctgcacaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggtaagtgcgtctcgagccgaggagcccctctgccctccctgtcccttgatggcagctgggcagaaagcctgggctggaacctgactggactccttggccatgcctgtcctcacagtttgtccacctgccaaatgggacaatgatcgttcaggctctgctctgaaatagcgcctgtctcggtagccgtggtctcctgcagtaaacctgcaggccgaggagctctcgggcgtgcttgggcattttgtaagccgctttgattgtatggaccttaagttcttcctgcaccagtgaaacccggctcacctcccgtcactgttcagattagcgccctggctcgttcctggttatgctttttaagggcctgccccaggtccgtctcttgttcctggtgcagcagagcccccaactctttccatgtgctgcaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcaggtacctgggcgtgggtgggctgtgctgggcaaggtctcagccacccgcggggaggagccctgaatcgcagcacctgccggttgccgtggtgtaaatgttccccagctgagttcgccctaaaagcgtggtgtggctgaacatggagtagggagcagaggcacgttggcacacgatgtagacacagtggatatagctgaccccaggaggacagttgtgaaatgtagccggggcattaggaagggatgttttgagtgcttcgttgattttatttctctgtaagtttacgaaacaattgtccagtaataacaaccagcttttgca

SEQ ID NO: 10337 - DNA, 1387 bp, Homo sapiens
agcgattctcctgcctcagcctcccgagtagctaggattacaggtatacgacaccatgcctggctaatttttttgtttagtagatggggtttccccatgttggccaggctggtctcgaactcctgacgacaggtgatctgcccgcctcgacctccaaaagtgctgggattacaggcgtgagccaccacgcccggccgggacattttcaaatgtaggtttacccttccatccagcatgtttgtactctacatgcttgtccttacagaggaaacgggttggttttgacacaaatttccctctctccaggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaa

SEQ ID NO: 10338 - DNA, 1572 bp, Homo sapiens
caggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctg

SEQ ID NO: 10339 - DNA, 1300 bp, Homo sapiens
ctctagtttagaaatggggaaacaaacaggtccagagagggacagtgcctcgcccagggacacacagcaaggtgggagaagagctgggctcctgctgcagtgcgcctcctgcaccccagtactgtctaatcagagagcccagtgtgggcggacagaggcgcaggtccttagctcggctgtcaaagtctcttccctctctgagcctgtgtcctcacctataaaatgggatcataccaccttccctgctcccaggaccagtgggggcataggggagacacagggttactctacaaagtccgagccccagggaggttcctgaacgctgggaggggttcctcttaaactgaagcagttccggggtccgattcacccagaaggatccagcatcactgggctgggtcccatctcagcctctggcagcaccagaaagcaaggaatcccagaggccccagccctgcagttcccagggaaacggggcttggtgtggtgggggcagggtgcatccaggtgtccatcccctctttctcctagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaatagtgaatcctttttttttttttttgagatggagtctcactcttgtctcccaggctggagtgcaatggcatgatctcggcttggctcactgtagtgttgcctcccaggttcaagcaattctccggcctcagactcctgagtagctgggattataggcatgagtcaccgcacccggctaatttttgtatttttagtagagatggggtttcaccatgttgg

SEQ ID NO: 10340 - DNA, 1440 bp, Homo sapiens
gacccacaccagtgagtgcgccccatgctgccgcgcgggctgggctccttcagcgcccggccacgtgagagccactctcaccccgcctgtgttttcagttagcgttttctccagaagcatgataccaagcatattccccggctcctgtaggccccagtgttccagcgcttccaggcagtagagggaacctcagtggtacccacaggtcttcccaccccaggcgctagagcacagacactcttcccaggcctgtgctttgatgtatctgtggccactcagaaagcttcagtcatctgcctccaactttctcagaattccacgtgaaaggcgtcccttccatgtattaaccatgtcttctatgctctgtatacctcttcatgcgtttgaaatgcacatgtttctcagtactctgcaccatctctgttcataccactgtgcatgtggctggccttctctcttgatgctgttacaagccgcccgttttcactgttagatgctgacttcttcatgtttgacccgtagtgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatcttgtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaaca

SEQ ID NO: 10341 - DNA, 1209 bp, Homo sapiens
caggctggagtgcagcggtgcgatctcagctcactgcaacctccgcctcctgcgttcaagcgattctcctgcctcagccttccgagtagctgggactataggcacgtgccgccacgcccggctaattttttgtatttttagtagagacggggtttcaccatgttagccaggatggtctcgatctcctgacatcgtgatccgcctgcctgggcctcccaaagtgctgggattacaggtgtgagccaccgcgcccagccctgcaggtaactgttaatgtaggaagtgctgcctctgggcaccttggccccagggttcattagcagttgcccctggtgggtttttgttggctgtgatgagaagtgcttctgttccccctccaccacactcctgcaactgtttaaacagtggctgtgaccccctgagatgatccagggtttcaaggcgtgcacatgtctgtgtttcggttttcagaagtatcaccttggggtgactctcaacttacatggattttcaaagatttattcaatatgtttttcagaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagaggcagtcttgcacaggagggttgctctgctgggtttcggggtcactgtgccagggccccagtttatgtgctcaccagtcacttagctctgccagctgacaggatcttttgctaggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttctttccttgccctgtcacatgcctgcgtgggcacgtgtgtgcacgtacgtgcgtgaacatgatgtggcctgggtt

SEQ ID NO: 10342 - DNA, 1232 bp, Homo sapiens
ggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacagacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaccctttgtgatcagttctttaatgatacctaaatgaaagctaattaaaacaataggtttctcccaagggtctggagtaaatatattttgggtgcaaatgaaatggcaaaaatctagtatcttaaattgtataaggggacattatataaaaactgaaaatatagaattccttgatgtaggaaatttgaggtttttggcaagagatctttatataagtaaaatcccattatcgtaggcacaccggcaggagttaccacaaccctttttttttgttttgggagacggagtcttgctcttgtcacccaggctggagtgcagccgcacaatcttgggtcactgccacctccacttctcgggttcaagggattctcctgcctcagcctcccaaggagctgggattacaggtgcctaccaccacgaccagctaatttttgtattttttagtagagacggggtatcaccatgttgtc

SEQ ID NO: 10343 - DNA, 1760 bp, Homo sapiens
gtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaactaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagac

SEQ ID NO: 10344 - DNA, 1195 bp, Homo sapiens
ccagagagtggtcccgggaattgcactaggcctggtgcccggtccccaggtgccaccgatggggctctctctggctcctcctgcggaaaggaacttggaaagaagggcccacttgccccgcctggggctccggcatttctgttggccacgtcagcctgtggcagtgtgtccatcggaacctgtctctccagacctgctggtgtggcagccaccagggccttgtgccctggcttgtcatgggagcaggtcccgtttgaaattaagttgacttagtggcccagcaactctcagatgggctcaaggaacattgtgattgtgcagattgtcaagcttttccggatgtaactgtgagagcgatgttcttttgtgactttctacaccctaagtggatgtgggccccagaatagctctgacgggaggtgtaaatcatatcagaccagcaggcggcaccatggagcacctgccccaggttttcctgcagtagcagaattctgctggtgttggatgggtctggacacacctcctctaccttgtcctctcttccagctatgtcagctctatcctgaagagaacttggagaaactcattccttgcttagctggtccggacgcattttatgtggagcgaaaccacgtggatctggactcaggcctgaggtgaggcccttaccaggcacccggcgcgtccacagctggcaaggacaggctggtcctgtggtcaatgctgtggtcctccaaggagctctgggaggatgcgcggtcacctggacctgggtctctacttggcctctagggatttccattagttctggaggattcgggagccctcagtaagctgagagtggttctgagtgtgtgaggaagggaattccagggtgggtcccaccacgtcttgggctttggcagtcctgtgaaataatcctgggctgctgtttccatcctgtagtccaaggttgagactattcccagataaaattggcgtctcttaaacagtttctctggaccctcgatcgtgtcttggctcacgtggcacacgaagtaacatggccgaccagttccgtaaatgtgctgctgccggggccctggggaccagtgtccaagcacctttctggctggtgggtggcactgatctcatgtcacagggcatgactgctgtcgtcaaccttggtggccatgaatacagcattgagaggaag

SEQ ID NO: 10345 - DNA, 1190 bp, Homo sapiens
ggtgctgacgggagctgcggctctggcggcacaggacacgggtgcatctgctgctccgtccacagcatgcttgtttgtggatggccgtccgagccgggccccgaggccctgggtctgagcctccagccttgctgcctgacccagggcccctctgctgccgtagtcacacgtcccctttaccccaactgctgctgggatcgagtcaccatgcagtttttaaagatctgagactaaagcaaaatccacaaatctagggaaaggtggtgaactgttggcacaggatgtttgctgttttgtgagaacaccgtgagccggggtggagggtggcaggaggccccgttggccagccgctccgttatgggggtgcttttgcatgtttgccgtctcggatctctgtcctgaagcccaggggaacgcagtctgtttcctttgtggatctgaagggggtcggggaagaggagttaggtttcacattatggttcttaagaaaatggaatccccccaggacgtagccaccaccgtcccgcagcctcccccacctgcctcagctgcgctgacgtgtatgtgcgttcattctgcttttgaagaaactcaggagtggctggaggagacggactcggaagaggacagtgaggaggttgagggcgccgagggtggggtcgacgacgaagacagcggagaggagagcggtgcggaggactgaggtgagcgggctcgggctggcgggtggcgcggctgctgggtgttcgtgaaaggcttttcatgtttatcggatgcttattggaattcagctttgtaaattttttaaaaacgttggtgtgtggagtaatttgggcagcttgctaatgagtgccgtgtgcctgtgggctctttgatgaggtcttccctgaaaacccggtgttctctctacccctcctgcacgggcctccccctcggctgaatgtgtttctctctcattccttcctccttgcgtatcagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtgg

SEQ ID NO: 10346 - DNA, 1018 bp, Homo sapiens
gcgaggggtgggccgagtgggatgtggcacttccgcatttcagttgaagacagcgcctcgggcacccggcacccacatgcgcaagtacacaagggaaggttccttaaaatcccagcgctgggcagcggcgctgggtttggtgacagcagggctgggggagccccagctcacgcccccgtgtcccacgggtgcctacccagcccccaggctaacacagctgtcttctctcctgacagtctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccag

SEQ ID NO: 10347 - DNA, 1198 bp, Homo sapiens
ctccatccttggcctcaggccagccctggtgcactgcccgctcccaggcttgacgagaggctgcgggccagtgggtgaaggggcgcgccctgactgccaggccccgcccaggcgcatccgggaggacgggctgggatgacgcgggcgccgggaggggggaggtcgcgaggccggggtctccatggcgcaggaggactggggccttcgaggaccacgcgggcctgggaatagcccgccaggctgggccggacgacgcacgtgctccgagctgggccgagggggcggggctgagggacggggccgggccacggggcggggaggagccgcggacggtgggcggggccggcgggccggggcctaaaaggcggcgcgggcggggttcctgacgcagctgcgggcggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgcgtgagtacggggcgcgggccgggggttgggaggtcgtagtctctgggtccctgcatccttgcatcactacgcccctggctcccacatctctacatctttacgttcctggaccatcccggcagttctaggctaaggtcattggtcccagaaaccacgtgcgtttctttcattcattcttttacacttctcc

SEQ ID NO: 10348 - DNA, 1239 bp, Homo sapiens
gcagaaacggagtatgggttgtagtctagatggatgcgtgcagctgggagaaacttgggaggagaggtggcgtatcaccacggagaccagtggtatgggtgggaagggatgcttctttctggggtgtggtgagtgtagcagggctgaggccccttgggagcaggaagcgacagagcgtttgctgtagtcagtcaggccccactggagacttgggctgagggagaggacgtttccaagccagtgttgggaaggtggctttggaagggcatgaggaacacagtggaaacggagaggccccgggtggctcgtccagtggttaaggaaagaggcagcgggtggcgttttcaactatttgttaattttcaaagaaactaaccttttgggggtttgaggcaagaagaaccctgcatgtaaaactccacagacgttcgcggcctcttgcatacacgtgctcggctcgtggttttcataatttcacgtgtagcgatggttaatgtcctctcctcctcctttgcttctgtttggtaggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacagtaggtgaaatattattctctttattcttcaaaaaccaaaagctgctccagttattttctttcctttaagcagaagaaaaagtaatgcatgctgcgtatgaaaagtttgaatcctagagatgtgaacactgtcggcccctcccttccctcgcccctgcagcctcagccccacgtcccttctggagggggcccctgtgacactttgtctcgagggccatccctgctcccactccttgggggtatgcgtgtgttctacactctctcccctgccgcgtccctgtgtgcggcgtcgtggatctttaccatgttgtatgtgtaatcccctgtgtgcggcgtcatggaaccttaccatgttgtgtgtgtaatcccatgtgcggcgtcatggaaccttaccatgttgtgtgtgtaatcccctgtgtgcggcgtccaggatccttaccatgttgtgtgtgtaatcccctgtgtgtggcgtcatggaaccttaccatgtggtgtgtgtaatcccctgtgcgtggcgtcatggaaccttcccatgttgtgtgtgtaatcccctgt

SEQ ID NO: 10349 - DNA, 10940 bp, Homo sapiens
cgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaaaggcgaaggcactcccagggaggaggggaaggctggtgttcagagtgtgggagaaaaggaatccctggaggctgccaaggagaaaaagaaagaggacgatgatggagaaatcgatgatggggaaatagacgtgagtatgatggagcagagcgtcgcggggcatcctgcccagcagcctgacatagactggtgctggaaaggagggactctgtgtgggactgacttagtgatttgttactagggatggtgcaggagaatgagaggcttgttttgggttcagtcccatagtgattggagagaaagagccagaaatcgagaatgagcagaggcagctccagaagctgccagcagggtttccgtggccctcggccggccagctggtgggattgtttgggttgtagtgaaaggtccagcgcccagtgtttttaggttctaggaatgaagggttaatgtctgtccttgtctttgccgtcttcaagtgatactcaagttaacactcaaccagaaaccacgtgggtttccactcttgtcaggtttttggactgaaaagaatgaggaaattttccatctggttttggatgttttaggcatttttatgctggtcctagagcctgacctctggagagggcaccagctgggccaggcctctttggacatatccctgaaaagactgtggtgggcacctcaacttctgacaaagccagcacacttttttgtacattaaattaatgtggccttcaggttgaggggaaggtagtactatctatgatcctaggtatgggtaggtggggttttcttagcagttgatgccgttggaaaaactatgagtgtttcgggagaaacaccccaaagtcctcctgagtgatacttgccggagctattgaactcaaaggaggtgagcaagggacagagcagttgaactgaactgggtttttgttgttttttttttgaaagatcctggggaaggggattgtgcttatggggagtcattgcggtgaagagtgtctgccgagagtatctctctgatgtcatgctctgggttgaggcaggtaaaggctgccagttagatgtgtaaccgccggtttgccttgaatgccatgctccttttttttgagagagagagtctaccctgtaacccaggctggagtgcagtggcgccatctcagctcactacagcctctacccccaggttcaggcaattatcctgcctcagcctcctgagtagctgggattacaggcgcccgccaccactggctaatttttgtatttttcgtagagatgaggtgtcgccctgttggccaggcttgtttcaaactcctgacctcaggtgatccggccgtctcagcctcccacagtgctgggatcacaggcgtgaggcaccacgcccggcgggtgccatgcttctccagtagcatgctggcgtgcgtgctctcaatgcacgtttggatatgactttccggccatcgctgctctctgtggcactgctcagtaatttatagggtttgaagtattgctcatgtgactttacgggacgtgtgtgcacctgcaagctgagaattttagatgtttcatctttccgcagcgaagtgtaggaagtggtctcctcagctagtgctttttgcaagaggagacctaccccagggctggcagagggaaaggagagacggtgagattcaggttcatcagctgggggagctggttgggttgaggatgcccatgagactgagtttttgtgtcctgggggtaacagccctgtctgcaccaccactgggagtgcagcaggtcctgcacccagggctctggcgtgctctagttcctcttaagaggactggctgcagaccctcaagtcttgggggagattcatcagacggatcaagggtccccatagtggtcctgaaaggccatgtctgtggagcatactgtgagttctcagtgccgcaccatgggcgcgggcggtgcggtagatgggtccagctgctctggagaatggccctggctgccaagggcctggacatgctggtttcccctagacacagcacatggaagaaaaaccccatttgccatttttgcctacctagaccttgcctgccctgcctggcaccgtcttgtgaggggacccacagttgaaaacggagtgctgctgtggaaaccccagcacagctcccttggcaaacggggaggcaggtttcttccaccgcacagactgcctccagcgccccacatcccccataggtctgtgctcctggacaccagcacaggtggaccttgctgtgccacatgctgagtgtgactgggcagggcggagcagagcccgctcctgctgtgggggcagcaggcctttaaccaaggtgggcagtgctgtgaatggtgggttcagcctctacaagagcacatttgacttcaggcccctgggttgcttgccccaggagcccccgtggtctcctcttgttcccacgcccagcagcgtttcaggctcctccatcctttatgtgtcaacctcagcatttgcgtaggctgtttctctgttgcctctgcctctctgtcgtgacacaggttcatctgtgtgtgtgtgtgtgtgtgtgtgtgtgtgtgtgtgtgtgtgtgtgtgtgtgtatatgtatatgtctctgcctgctgcttcccctattcccaagaacatgtttcctaagactgggggctacctggctggttcccctatctccctggggcctggcacatagtgggcagccagtcagtagaggaatcctacttgcccggggcacattgaaggtgagaacctttgtaatgtgaagtggcagtgagtggaaggtccacgctcaagagccagtcacagatggaagggagttcacgtgagcagcatcagccctccacccttgtgggaaggacccagcagaggtacgcgccacgccatcctgtgcatgaagagctgccgctccggctgcttccagctttttcctcctctcaggcccagttccaagcctgtcgtccactcttgcatctctgccgtatctccaccaagcccacctcctgtgcctgcctctttctcagaggccctgctgcattcctgccccgcgccctgctccctgtctctagctgggtttctctgatggactgggagccctggggtgcgccgggtccgtgagcagtcagcttcccaccaggcctttcgcccggtcccctttcctttcagtccctggaaagcagcctctgcgtgtggtgcaaagtgtccgttctagaagacatttttctcgttgctttcaagtagagccctggtgtcacgtctactacccagatgtttctctgtggaagaattactctctttggcctgtaccttcgcaaatggatgtttctgaggcctcatagcattccaggtcccagcagggtcttaccggcccagtcaggagagggactgattcgcctagaggctttccctgcatgcctgcagcctcgtggcctaccccttggcaccctggtctactggatacctggaaggattgaatggcaaagtctagagagccgtttgatttggcattcttttctctttttcttagttttgatttttaatttttgttgcttttaatttaaaaaacagatggggtctcactatgttgcccaggctggtcttgaactcttggcctcaagtgatcctcctacctgggcctcccaaagtgccaagccactgtccctggcctgatttatcattctttttcagaagcgctttctcttctctcagggcacatgtcccttttagattttgggtcactgggacaggtgaactgattatggggtacactttccttgatcgggacatcaatttgtacaataagcccttgaaattgtttaaaccacatagcttgtgcctaaggccttgaatctgtgtttggtatgctgccagaacaccccctgatgcaagtatcttctggaagtgccgctggcctgcgtggtggggtggaaagtttccgtacagggctgggaccagcagtttgcagcacctggctcatttgtggtgtgggtgagggcgtccctgacaccagctgaccttcagtcaccggtctcttacctgttcaggaagcggcatggaagagagctgggtgcagcaggccttgtttttatgctcctgccgtccaaagagtgcgtggagcccaccctgacccactcatgccatgtggcagcctctcctttctcctgcacgtctagtctctccccagaaccacctttcctgctgggagatgacaagctccttccagcctggcgaggctctgatttgccgttacagttgagaggcctggcctgggtctgtctgcccgctcttttgctcactccatgttccgtgtttatatctgacttgacatttgattagcaggccttccgtcacctggagcacactggcccttggaaaggatagggttcccattttgttccattctcctcttattgaggacctcctacatttgtagggtggcctcctagtcagccagcagcgcagtgggccctgtcctgagtgggtgggccacatgactcctgtcataattggtagctctcagtccaccttttggaacattttctttgcacatggtctttaatattttctcctgtttaaatccacctttcctttttcttttctttttttttttttttttttttttgagatggagtcttgctctgttgcccaggccagagtgcagtggtgcgatcttggctcactgcaacctctgcctcccgggttcaagcgattctcctgccttagcctcccgattagctgggattacaggcatccgccaccacggccagctgatttttgtatttttagtagaaatgggtttcaccatcttggccaggctggtcttgacctcctgacctcgtgatccacccgccttttatgtctggatccatgagctcttctgcagaagattcttcagcgagcctcatggctgtgggtttccacttcaagtggggttctcttccgtgtcactgataaggtgccaagtgcgcccattctattgccaaagcccaggaagcagcggcctgtaccacacttggaaaaagggccccgtagcatcagtagtaggctcagagaccttctgtgccccttagcgtggttagtgttccacatagccacatgaaaaagcgcaggccaccgtccttacagctctgaggcctcagaagctctgagaactgaaaccttttcctcacctggtggcagacctggcccaagctggcgtgaggctgctcatagcctcctgcctcccctcttgtgggagggtccccgagacctctgcacaggattgctgtgtacctcgcaggctaccgttttagaccctgtgttgtcacctttctgaagccagaatatttctgaattctcaagacacctggccccacaggtttcagttaaggaatgatagacccgtattttcacccacatcctgcagacaagatgcccaggattcaggaggttgtggttggcctgagtggccgtgccaggttgggcccggggcccggctgctcggcttcctctggcacagcagctccacgcagtggccccctttccttatctgcatctgcctttgtacagaagctccagtgtgaaataacttttttcttgttgtgtaagtaatacatgttcacagtgttctttctatttaagaaaggaaaagaaaaggctgcacaaagaagaaagcgaaaatcccctgtgtcattgctctgagttagtcctgtttagcacgttaccagtgaggcgtttcctttgaaatggaggactcaggcgcgcttgctgagcacttgctgctcatgttttaagcacggtgcagcattttccttcagcccacatcaccctgctctggggcacttgccccgtggtgcaaaggggaaggcgagctttgcagatcaggtgacttttgcagatcaggtgacctgtccacactcacagtcatgacagcctggacccaggatttgaacctgggccttttcccccactgcatgtgaattttataaaggctcttaaaattggagtagatgatgccctcagcctggtgtcctttatccacgtgtgtatttcccctgtggtgagaaagcaccagcaggagtgtgccagcgtggagacccggcttcagatgggtgcactgaggcctgtgtgtctcctcacactcaccctcagtgtccacgtcaacttggcctgtcccaggtggtgtgtgttgagagccccacgggcaccatccgtttttaggccaatttgtagctagctggtccactcaggcccctccttgtcctctgcttcctactctctgtggctcgggtcacatgagcagaaggccatcggcgtgagggaaaccaggagacccggagttcctgcgtggcagacacttagtgtgacaatctcagatgacttcagctctgggtccctgtcttgagttgtctttgcatgatattctaaaatttaagaacttgttttaattatccattatttagtgatttgtttatttattttgggaggttaaatattttgttatttacacatataaagtaagaataaaaattgggcacggaggctgggcgtggtggctcacacctgtaatcctagcactttgggaggccaaggcgggcagatcacctgaggtcaggagttcaagaccagcctggccaacatggcaaaaccccgtctctactaaaaataacaaaattagccaggcgtgatgtcgggcacctgtaatcccagctactcaggaggctgaggcaagagaattgcttgaacccgggaggcagaggttgcagtgaaccgagatcgtgccactgcactccagcctgggcgacagagcaggactctgtctccaaaaaaaaaaaaaaagcatggtaatcatccattatttaaaagaccattgtgctaaatggtggttagttgaaaattcacaatattatattgctgagtgattggtggattatttttgtttgtttgattttttaactgaaaggggccataagcccagcacaccaatatgtacagcccctggtccttgcgggtgtagaggctgggtgactggggtcagtgtgtaggtgctagtctgtgttctttgggttgaaatgatgtctcgcaccttcagtatgcaactctggtctgtttaccgatcacctttagtagctacagggtcctccctccaatcttaaggtggttacattgttctccttttttgcttctgtgaatgttggtggttacatctttgcagaaacaatgctacatctgatctagtttgtttcctattcatcctgatgcgggaaaaacccttctcaccacctcatctcctacacgctcacttccaagtaaggcaggaagattggaatggattcgaactttccaaatgagttttgtttttctcatgggaacaaagaatgtgttctccacttagatttgagcttacatagaataccacgttgagattttagtgtggtgctcattactgtaagaatagtagtaaaaagaagacacaaactaaaagaccagagaagagagacatcctgtcacttggcataaattaaacatgccttctctgatcatttctttttttaatttgttatgtttgatcatttctttaaaaagtgattctgctggattacttaagggatataactctcaggaatctgttcttttccttataaaatactttttaataaccagatatctttgaggcaaaaaatgatgcaaatatttaagctgtgaaagtttaggttgtcgtaaatccagggtttggtttcagcattttttcattcaacagataattacggactgtttactgtgagccagatgctgcctgggcccagcaacttggcgatgggcctgccctggcagacgtgggcctgccctggtggggcacagggttcagccaggcaggtggtggtgtcgtcaacacaagggtgctcaggtgtggctgcaacacctgcagggcttggggctgcaaggacctgtcgtagggggagctcagggaaggccaccccaaggaaggggactcaagcttccatctgaaagtaagttgaataatcaggaagaggagagggaagaacgcggtcaggcctggaactggaaaagggcgcttcacactgtgaagcgagactggaggagttgaggagggaatgagagaggtcagttagaaagtggttttaccaggctgggtgtgatgggcagtggtgcagattgcaggagatggggagggggatcaagaggggccacatgggaccggtgagattggttacgctagggctggctggaagaggccgggatcaggctgacgagtacttccatcttggatggtcctgtgtcagggatgtcaggtgggcagctggtgcccacgtgggctggggtggtgtaaggaggggtctcagctgcacgtccgtgggaacaggccctgggacagtgggtggcttggggagagcaccaagcaagggtcaggtttggctgtgcacccgagtccctgtgggtgaggcccagcttagagctcctgggttgttctaagacttgacagtcagggtgaggagctggttgaggatgagcctcaaggcgggccactcccaactgctggcatcactgccctgaggcacccaactcctcccctccccaagaattgtaaattagaggatgtttgtgtttaagggacataaaatattttgttctccatattttatttaaatgttaaaagttttaaaaccccgaagtgttactatttcctgcccagagttgatagttaagagaaatgtcacgaaagcccactctgtaaattgccctgtgtgctgcacagtgcttctccctggtgctgtggcgggatgcttagagctgccgggcacgctctgatcatccctgctatgtagatctgggacctaagatttggaaaattgacgtgaattcaattcctgtgacaatatccaggttccacacgcagcttcctgccccttctggtttggagaaagcagtgctgattgatagatgcctcccccacgctaagacggtgttctctgtttcaggatgatgacctggaagaaggtgaagtgaaggaccccagtgacaggaaggtgaggcctcgtcccacctgccggttcttcatgaaaggtaattgtctgcgtgtgaggccttctcgcagccagctggggccccaccttctggggctgtggtgctggctcaccttgccaggccctgctctgctcaaggcagttctctgggcattactggctaggtggtggtggtggtggtggtggtggtggtggcaatattgatggtaaacaataggcccttttattggtgcttttatcactttaatgactgccttggtgggagcagcctggtcattctcattctcacactggtggtcccaggcccttccgatcgcagcagacccataactataatgcagatggcatcagtcatttttcaaagtggtccttttcataaggccgaatgttctagacaccagaattagcattttccccacctctgtagagatggccgcttttcctgcaagatgtgtccgaagcgtttgttcgtgtggaatggatttcgaaatggccagagatggccgctgaaggcagcagggctctctcctgtagaaggaatggtgtgagttcaggagctgcagcaggggacagtgtaagaaagtgtcagaaaagtctgggctgacccattttaaaatgtggcagaactctagcctgatgatgttagggctttttgtttcgctgcttaatgtcttgggggattcggaaatggaaatgagaatttccaacttgtaagggtatctttgatgtgcagcagtagttttggcatatttcttgtaattcagcgttccccttggaaaggtaggaaggtgtttttctcttttctcttaattttgctgtaagcccatagatgactgtcactgccagcctgtgtgtgccatctaaagctcacaagagcttcctgtacttcttttccagatgttgtgacaccattatccactcttcttccaccaatatccaattccataccattcagaggccaggttaaaggtacaaaatacgctatattcactctcttcagtaccttaaagtccccctactccagaggccagacttccttctcctggatccagaacacagctgtgaagccagaaggaaagggggtctttgaggggcagagagctgttcggaacctcctccttagaggcacgtgagccagtcgagcatcggggacaggcaggacacacccttggggtgtggcggagtcccatcattcagaggcaggctgtgctcttagagcagccgggaacgcccctgtgcaagagatgacctgatgatgtggggctcatgggaaccccgggttaggctcgctcctgtgggtgtgtgcttgcttggttttgccaagcaaaaacagttgacgtgcccaagtcacacgtgcatgtgaggggcccctactggggagagcctgtgagggcagcagacttagagccgtagattgtcacagacacacc

SEQ ID NO: 10350 - DNA, 1754 bp, Homo sapiens
cagcgaattgcagccccaccccccacccccccccacacacacacacacgctcctgccctggttgaggctggagggtgccctctgctccgcatgcccttgggcaaaagatccctgggcacagaggtgggaagaataacaggaggttgtgcggggccagcccaggaccctcccagtctgctccacaaagcccgggagccagtggctaggaccaggcctgcttgtggcagtgggagcctggccatccagggagccccttgcctgtcctggtggccgctgaggacacagtggaagcgcccctacggggaggtcaccccttccacctgcagacgtggcttctgggggctcaaggtcttccccacccccttgtaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcagctgtccttgccctcgtggtgtgtgcgccctctgcccatgcgcagccggggctgcctctgtgtcgtgcactgcactcggcccagcactcgggagccgctggggggcgagggtgtggctgtgcactcactccccccgggaggaccggctgtggagcagctcctgccttcagacccagcccaggagagcattgcgcctcagtttccccattcgtggggctgggttggggcttccttggtccgtgaggtggaggtactttccctgcaggggccgtggagctgctggaggggaagaggtccagggctgactcccagccccaagcccagctgccaccactgcagtgaccaccaccggctccgtgtgcaggccccagacctgctgagccaggccccgcgtgtgatgccacgttccacagcaggggccaccggcagagccccccaggacccaccgctgctgctccctgctttccaccttgaaagccacaggcctgcgcctgggcagcggcctcccaggtgcacgctcc

SEQ ID NO: 10351 - DNA, 1218 bp, Homo sapiens
aggtggggagtatcagacccttgaatagggagcgcctggggtgggggctgctggggtccctgggacccccccaccccaaccaccccagcagaccggagttcctgccctctgacctgctccgagggccaagcttgcatccagtgatcacggccgcccaagccattgccgccaccttcctctcaggggctgcctgttcccaggctctgtggttctctgtcccccctgtgacagaagcagtgcccagggcagggggctcgcagctggcaggggcggctgtgcctgcaggagctgcgtgtgggtgtcaccactcaggcgctttaccttctgaccaggacccacaggaagggcgggggcacaccgctaccctcctgtgtccggccctacagatgctgggcacaggatgaggcgctgccattcctggtgacctgacatggatttctatccccaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcaccgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccggcctccgccgtttttctgtttcgtaaaccagcatcccggggttcctgctctgagtgaccctggcacctgtcagggagtccaggtgtgccccatgagggcc

SEQ ID NO: 10352 - DNA, 1215 bp, Homo sapiens
tctattaccagaaccatcatacttataaattctttatttttttccagaaatagaaaaaaagtctgttttttttctcactctgttgctcaggctggagggcagtggtacgatcaaagctccatgcagcctcgacctcctggctcaagggatcttcccacctcagtttcctcagtagttgggactacaggtacacaccaccatgcccggctaatttttttcttaatttttttgtagagatgtgggggggtcttgctatgttgcccaggctgatttgaagtcctggcctcagggaaccctcccatctcagtcttccaaagtactgggattaggtgtgagccactccacctggcctgtcaattctttgtgtattttttcattgacgtgcatagtacaagcacatagcgtgttctcccaccttgctttttctacgtaccttcttcttagagatcatcccaatttagtaaaaagcttccttgtttgttgtctaaatatacctggtctgtcctagttgggttgttactataaacagtgctttcctacgttgtttgtgcacatgtatttctgcaggagaaattcctggaagtggaattgctgggccaagtgggatgtgcctgagtacttttgatagctgttggcaagtcgccctttgtggaagtcaattgattactcaggtctctctgcggaagtctgagagtgcctgcatgccttcaccagcacagtgggtcacctgccagagtgacatgtgttgtctcactgttttcaatttgcatttcagatggtggttatttttaatttctcttgcaatcacagctgcttttccattttatgcaaagccactaaatcctattgaagagctgatgtggactgtctcggcctatagtcagggtgtattccctcagctactcagagagagtggggcttccagtcacctccttccttctgccacggctgtgatgaaaaagaagacacaggcttggtgctttgggaggccaaggagggcagattgtttaagtccagtagaaaaaaaaacaatttatttttgtttagagacagggtctcactctgttgtccaggctggagtgcgatggcaccatcagctcacagcagcctcaacctcctgggctcaggtgatcctcccacttcagcctcccaagtagctgtgataagtgccaccactcctgactaatttttattttttattttgtagagatggag

SEQ ID NO: 10353 - DNA, 1193 bp, Homo sapiens
tctccttcctgtctccctcgagcccggtgcatctctccttcctgtctccaggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccacttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagcatctctagca

SEQ ID NO: 10354 - DNA, 1216 bp, Homo sapiens
caggatactgagccctcgctgtggcccaccccatttccgcacttcaccccaaagaggtggtgtctctgcatggtgggtcctcgctgtggcccgctccatttccacgtttcacctccaagaggtggtgtctgtatgtggtgggtctttttttatggggtctgggttggccttgccctgtacgtgcctaagtctgtccactccaccagctgggcccttctgagcgcctgtggggaggggtgccggggctctgccctcgtttgctggatgcagcctccgtggctgtgcagtttgtacctggtcgtgggaggggccggtgagcctcgtgttcaccctgaggaagccactgccagaggggccaaccccgcccctttcaccagtctctggacagagcctggatgtgaagatgctgcttttaaagatggagattggcaaaggacgtcgtcacctggcagcgcctcaggacgctgctcactgtgcgggtagcaggcggttccctcatctcaggtctgtgttgcagggactgtttcaaggccttctacgtccacaagttcagagccatgctgggcaagaaccggctcatctttccaggcgagaaggtagcgtctgggtcctgggggtctgactgagcagcctggcccctcgaggtccctgcttgtccctcccacaggcagcctggcctgctgcagcccgccagctcctccttggcctttgaggacagactcgatgtcctagatgtccacgaggtggggtgtctgcctgtgttggaggtgcggtgccctgagtgatgttttttctcccccaggtgctcttggcgtggtctggggggccttcgtccagctccatggtctggcaggttcttgaggtgcgtgttcaccaccccgtgggcccgggctgctgggctgagcttcaggctgggggcctcccttctcagcctgctgaggggctcttggttggggctagagagcagtccaccctgcggcctggacacttggggggttctcagatgtgttcacaacaggtgcaccaatcaggagctgagtccacagtgtgtgtgtgcggcccactctcagatgtgtttacagcaggtgcacaaatcagaagctgggtccacagcgcgtgtgtgcggcccactctcagatgtgtttacagcaggtgcacaaatcagaagctgggtccacagtgcgtgtgtgcggcccactctcagatgtgtttacag

SEQ ID NO: 10355 - DNA, 1104 bp, Homo sapiens
ctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggtgggcccacgcgtgggggcgctcggtctccaggggcggggcagtgcaggctgggggccctgcggggctgtttctgatggggtccttgacctggccatcccgccccaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggtgagtgcaggtccgccggggtgggggtcacggcccgggcatgagggagcccacctgacgggaaccctggctgtgggcaggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccggg

SEQ ID NO: 10356 - DNA, 1135 bp, Homo sapiens
cccaggaaatgaggggcaggaacccagttgggagatgacattttcggaccctctcccaggcaggatgcagtgagtgggaccccactgctgcgggaggagcagcaggagcatcagcagcagcagcaggaggaggaggaggaggaggaggactccagggacgaggggctgggcgtggccactccccaccaggccacgcaggtgcctgaaggtgggttgggcgggcagagcacagctgccacccagtctgctgtgccatgtcccagctcggggggcgttggcagagtcccctctgggctccagagcctcttcctcacaggggacccgggaatccccgtttgtgccccgcactgaccctcacaccatcacaggggcagccaagtggggcctggtggctgagcggctgctggagctggcagccggcttctcggacgtcctctcacgcgtgcaggtgttcctgcggcggctgctggagcttcacgttttcaagctggtggccctgtacaccgtctgggtggccctgaaggaggtgagtgtggcaggcaactcagcttcccatctggggtggggtcgctctggcctgcccagctggcctccccaagcccagccccacgtgcccactgccctccccaagcccagccccacgtgcccactgccctcaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgaggtaccggcccccgagggctgggacgggaggaagctccaggcaactctgtattcgcagcccgaccctcctggggcagctgcctcagtgcagtggggccagcaatggagatggaggactctcccctgggggcgccaagggggcttcctggaggcagcatccttcgacctcaactgtggaccaggggcgcactccctgcacacaagggtgtccagtaggggcggagtcccagggtctccggcagtgaggacgggagggccccacccctggacagggagagacagtcaggcatctctgcctgg

SEQ ID NO: 10357 - DNA, 1094 bp, Homo sapiens
tgctctacaccctgaccttctggctcctgctgcgccagtttgtgaaagagaagctgctgaagtgggcagagtctccagctgcgctgacggaggtcaccgtggcagacacaggtgagtggtgggccagaggcgggggttgccctcctgcctgcccgccctgatgccatcgcctgcccctggcttggcccacagagcccacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtggctggggggccgggatgggggctggggcacggaccctccccgcggtcctcaccacccccacctcacccggcaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagtgagtccaggctggggcggtggggcaggggcgccgaaaccccgtgcacttccccggggctgcagcggctctgccgggggccgggccggtgctgatgctgcccctccacaggctgggggacctgggcctggagcagttcagcgtgtccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggtgcggccccgccctccctgtccggccctggagaggtgtagcctcctgggccagggagggagccaggtgggagttggacaggagccacatcttccaccttcagatcccaaggggcatttgctcataccaaggggatggcagtagcgtggaggtcacagggacagtgggcatgagttgcgacacagctgtgcacctgaactggca

SEQ ID NO: 10358 - DNA, 1098 bp, Homo sapiens
agctgaccgctgtccccacctgcagtgcggcccaagcgggctgagcccagggaggcgtctccgctccacagcctgggccacctcatcatggaccagagctatgtgtgcgcgctcattgccatgatggtaggcggctgtgggggttggggtgggcggccccctctgccgcgcaggtgtggggcatcgcctgggtggggtgcgctgggcagctgtgcagccccctctgccgcgcaggtgtggggcatcgcctgggtggggtgcgctgggcagctgtgcagccccctctgccgcgcaggtgtggggcatcgcctgggtggggtgcgctgggcagctgtgcagccctctctgccgcgcaggtatggagcatcacctaccacagctggctgaccttcgtactgctgctctgggcctgcctcatctggacggtgcgcagccgccaccaactggccatgctgtgctcgccctgcatcctgctgtatgggatgacgctgtgctgcctacgctacgtgtgggccatggacctgcgccctgagctgcccaccaccctgggccccgtcagcctgcgccagctggggctggagcacacccgctacccctgtctggaccttggtgccatggtgagtgtgcaccaccacatccgggggtgcctgggtgcgcagacccatcagggttgtcgtcctgttcaatgtccacttgcccgggggagtggcagcgccaagaaggcagatgtgtctgtctgtccccttctgcccacccagagccagcccagagtagcttctcagtgagcgtttgttgactgaataaacagacaaccttgtgttggcacgggcaccacccctgtgccctgacactgtgtgagcgtgggctctgttggcacgggcaccacccctgtgccccgacactgtgtgtgagcatgggctatgcccattggcacaggcaccacccctgcgcccctgacagtgtgtgtgagcgtgggctctgcccattggcaccatgcacagccctgggtctcagtgacaagctgtgcaggccatgtgttcacagggtgcctgcgtgtccatgtgaaacgggtgccagcatcgtgtctggacacctgtt

SEQ ID NO: 10359 - DNA, 2491 bp, Homo sapiens
ggcgcggacccagacccctgagaaaaaggtcccgggcactgctggcgctgtgccctcagtccctcctgcggggggcagctcctgcctcggggactctggcaggtttcaaatgctcctgatgcattggtgtgttgtctgcctctgcccctgagagctgacgaaactgcgctggggagagggcagagcttccctgggggagctgcgtggacacagcagagctggggtgtggagccgggctttcccgtcaccactgctacccctaacggtgccagtgctggtgggtgtgcaagggccgcgaaagccatcgtgtgtggcatggcaggccccatcggagggtctccctggccgaggggcctgctgtggcgttggaggggtaggggcctactgcttctcatgaggctcctccctccctgacagtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggtgagtggccgggggtgggctgtggctgtcctggagttgggggtgggcccgggcctgcctcctgagccgcccccatcctcccataggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcagggtgagtgctgggtgcgggacctcggtttccccatctgtgagccgcacagtttccagggtgggtgtgaggtgctgggcatctggcccaggactggtcacgggtgggtggctgggtggcctggtggggacttaggcctggactcgtcccacagaggctgacggagcagccccccagctcacggcctcgcgcctcctgcagcgacggcagatcttcagccagaagctggtggagcatgtcaaggagcaccacaaggtgagcggcccccggccccgctgtgtgaagatggtggcaccagcactgcctcagcacctaaccctgtgcttggagcatccctgccactcacagcttctcccgggatggaactgggctgggttcaccctgagctgagggctggtgtgctcagggtgcagccgcaggcactgaggaggtccccaaggcgttcagcgagcgcggaccatgggaggccttgtgctctccctccaagctgagcactgggcagaggctgagtgacttgcccgaggcggcccggctgggacgtaagcacaggcctacctcacatgcagtctgcccttgtctcagatgtgcccagggtcacccatctactccttctccccaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccagggtgagactgcgaggcttgggcagcccatttctcccgggtgggtgggccagcctgaccccaggcttaagaggtggaagccttggtgatgagcttgacgcctcatctggcttcctccttggctggcggatccagagagttggtggcatttgccctctgtccccagctgcagcctctaagcctggctctgccactagccccatgtggggagttggcctgggcaggcgatgctgcacactgggacactgcattgaccggcacagaccacccagtgtgctgggtgaacttgtgccttgagagataccggggactcctgggcagacagccaggggcacgttgcatcttgtgacctctccagtccaacctgtccctcccgcagatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcgggtgagtcgtccccagtgatggcgggtgggcgcctggtgacctgctgcccactaaccaggtcccggtacctgctgcagatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggtacgtgcagggcggggtgaaggggcgtgca

SEQ ID NO: 10360 - DNA, 1409 bp, Homo sapiens
cagaggccagcgccacattggttgttgaagggcaggactcggggctccttgctgttcccacgccagcccaacagcccgggttgaaggaagccacagggccaattctgtgttgaaccctccccaggcccctcctccagtacccccccaccccacgccttcccaggcccccctcgggccatctgggagacagaatcaggaacaaggaaggggaaggcggaggcctcctgggctggacgtggacggctgaagtgtagctcacacacttggaccggtggggccggctcatgtggcagcttccccggggacgtgaggatgtcagggtcctccatttccaccttccctaggggtctggagcccaggccccaggccttgccagccctgaccaccgcacactgcgaggcagccgcccctaccacgccccttggcatcagacgatgggtcccccacccgccctggaaccggggccccagcagccgcatgcagcctccggcctccccctccgaaggctcctgggggctgccttccactgagtgggttttcccttctgcagtaactgccaggccaaagctgaattgtaaaagttgcgaaatgatgggccgggcgcggtggctcacgcctgtaatcccggcactttgggaggccgaagcgggcagatcacggggtcaggagatcgagaccatcctggctaacacagtgaaactgcgtctctactaaaaatacaaaaaattagcagggcgtggtggcgggctcctgtagtcccagctactcgggaggctgaggcgggagaatggccggaacccaggaggtggagcttgcagtgagcccagatggcgccactgtgctccatcctgggcgacagagcgagagtccttctcaaaaaaaagttgcgaaatgaagaaaagtcttggaatagagcacaaggcattttagctctggggattttcttgaaaggaaattgtgtttggggggagttatgcctcacacaaccccctgggtaccagtcctcgggcggccagggggttcacagctccccaccccaaggctaaggggtcacctggcctctgcaggcggacagaagggcttctgccctcgcggatgcgcgccctggcctggccacaccttccggcctccctcccccgggtccgggcggggaagagccgcctcaacggcagggcccatccgcgagaggccagcgcccccggccggtccagcccaggcccgccgcctccgccctgggctgctccctccgggccctgcaccgccctcctgctacttggaccgcttcctcacgcccttctccaccccgcgcgccagcctcccgcgcgcagcgtggggatctcggccaataaaggagaaagggcgcggcccgtacgcgcgccaggtgcgtgggcgagaccagctcacgcccc

SEQ ID NO: 10361 - DNA, 1353 bp, Homo sapiens
cagggcagggcccccgggccagggtgagccccaggccagggtagaggtggcatagacagcggttatggggacagacatgtagcacagctggcgctaccgccacgtgtagtaactagatgccaggagcgggtacagctgggcctggcccataccagggtaggttcacggccgtatcacgcccttggccctgctggcagctgaggtcggcagagtctggggctctcccttcactcctcctccctcctctccccgctgtgtgtcccgcagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaatgctctttgtacagtgcgtccctccaggagaggggctgtgtgtgggactgac

SEQ ID NO: 10362 - DNA, 1104 bp, Homo sapiens
cccccgagccactgcaagaccaccggctcggttgtcagctttcatattccactgtgcacgttacagcctggttgaaaggctgatttggggtgcatgggccctccctgtgaacacaggaagctcagcctacccccagccccctcctgctgtctcgctgtatctcctctgcacagttgggtgctcatgccggtgtttcaggccctccttggcacacgatggcccacagatactgtcccgcgcctctccctgcactatctcctcactgcgtggtgctgtacggggcaccgtggaggtgtccgctctcccgcgtccagcacatagtggtttctagaagcttcctggtgtgtctgttgctgggactggaggaggcctccagggcaggctcctaggagtggggaggctgagtcgggacccccgtgaactccagactatatccttcgtgcagttccacagccccagctgaccccccacactcaccttttgcctgtagatcgcaccccctccctccctggcggagcccctgaaggagctgttcaggcagcaggaggccgtccggggaaagctgcgtctacagcacagcatcgagcgggtaagtgggctggcacaggcaggggggcgccacggccagggcttttcacggcgcaggccccaggggctgtcgtgttgacagtggggcctggagcgtggctgtgtcccagctcactctactcctctcctccttcaggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccaggtagggcccgtctgcatgccaggcccatgagtccaagtgcctgcaccctgcccgcctcccctccccttgatagattctgcactttgaccaggagcttcccgggtgctcagcaccttgcaggggctacagagtcctttgcatgcctctagccttgggcgagcctcagaaaggagccaagaaggctgcagcagacagcagacagctccccgcacgggcaaggccctcaggccactggg

SEQ ID NO: 10363 - DNA, 2226 bp, Homo sapiens
gaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccgaggctcggcgatgccaaactgaaggagaaattcaaggacggtgcagagaaagaaaagggcgacccagtgaagatgagcaacgggaatgataaggtagcgccatccaaagacccaggcaagaaagacgccaggcccagggagaagctcctgggggacggcgacctgatgatgaccagcttcgagaggatgctgtcccagaaggacctggagatcgaggagcgccacaagcggcacaaggagaggatgaagcaaatggagaagctgaggcaccggtccggagaccccaagctcaaggagaaggcgaagccggcagacgacgggcggaagaagggtctggacattcctgctaagaaaccgccggggctggaccctccatttaaagacaaaaagctcaaagagtcgactcctattccacctgccgcggaaaataagctacacccagcatcaggtgcagactccaaagactggctggcaggccctcacatgaaagaggtcctgcctgcgtcccccaggcctgaccagagccggcccactggcgtgcccacccctacgtcggtgctatcctgccccagctacgaggaggtgatgcacacgcccaggaccccgtcctgcagcgccgatgactacgcggacctcgtgttcgactgcgccgactcgcagcactccacgcccgtgcccaccgctcccaccagcgcctgctccccctcctttttcgacaggttctccgtggcttcaagtgggctttcggaaaacgccagccaggctcctgccaggcctctctccacaaacctttaccgctcggtctctgtcgacattaggaggacccccgaggaagaattcagcgtcggagacaagctcttcaggcagcagagcgttcctgctgcctccagctacgactctcccatgccaccctcgatggaagacagggcgcccctgcccccggttcccgcggagaagtttgcctgcttgtcgccagggtactactccccagactatggcctcccgtcgcccaaagtcgacgctttgcactgcccaccggctgccgttgtcactgtcaccccgtctccagagggcgtcttctcaagtttacaagcaaaaccttccccttcccccagagccgagctgctggttccttccctcgaaggggcccttcccccggacctggacacctccgaggaccagcaggcgacggccgccatcatccccccggagcccagctacctggagccgctggacgagggtcccttcagcgccgtcatcaccgaggagcccgttgagtgggcccacccctccgagcaggcgcttgcctctagcctgatcgggggcacctctgaaaaccctgtgagctggcctgtgggctcggacctcctgctgaagtctccacagagattccccgagtccccaaagcgtttctgccccgcggaccccctccactctgccgccccagggcccttcagcgcctcggaggcgccgtaccccgcccctcccgcctctcctgccccgtacgctctgcccgtcgctgagccggggctggaggacgtcaaggacggagtggacgccgtccccgccgccatctccacctcagaggcggctccctacgcccctccctccgggctggagtccttcttcagcaactgcaagtcacttccggaagccccgctggacgtggcccccgagcccgcctgtgtagccgctgtggctcaggtggaggctctggggcccctggaaaatagcttcctggacggcagccgcggcctgtctcacctcggccaggtggagccggtgccctgggcggacgccttcgccggccccgaggacgacctggacctggggcccttctccctgccggagcttcccctgcagactaaagatgccgcagatggtgaagcggaacccgtggaagaaagtcttgctcctccagaagagatgcctccagg

SEQ ID NO: 10364 - DNA, 1297 bp, Homo sapiens
aaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagaccgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaa

SEQ ID NO: 10365 - DNA, 1325 bp, Homo sapiens
tgtcttcatcagagctccgtggagagcccctggttgcaggcaggacagcaaggctgaggggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttttatgggctcttccagagacgtgaactggaaaaggctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcaggcccagggcagccccatgggcccttaaagcttgagagcctttcctgctgagtctgagagatgccagaagcaggagaggttagaacccgaggagggccgcacctgcgctgctggccttagaggagggccgaggagtgtggtggcccctaagcagctgggactggggacctccgtcccagccctgcaagaaactgaattctgccagcagcccccatgatggaggaaaggaaggatcctgccctgccagcaccttgacctctgacctccacaattgtaagcctgaggttttgtgtagtcaccatagaaaactcacacacataagaactctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcagaaacttggtctttgtttcctctattctgtccccccaaccctt

SEQ ID NO: 10366 - DNA, 1107 bp, Homo sapiens
gctggtcgtagttgttattctcagcgtccctattattatcgctgttttgaaatgagagcaggcggctctcgggctccgagccggagggggagggcgaactggggacctgggggcgtcggggttgcaggaggcgcgcgtaggccgaggaggggcaggaatgcgggcagccgtgtggggggtgttagggggagggtaggcgggcgggtgtggggggtggctgggaggaaagcggtggcggtggcggctgcaacagcagcccttggcctcaaggaacaatgtgagacgttgcctgaaatgttaatttccgttcctcatttcatcatcccctggcagggcggtagctgtgtgtgtggtgtatgtgtgtgcgcgcgcgcgcgcgcgcgcgtgtgtgtgtgtgtgtagggttggccctgccacattgattcagtcccctctcaaagagggattgtactgttaactcttgtgtttgtgttatttgggaaggttggtcggggggagtcttgatttttctcgaggcttgctcttttcctggtgccccattaagattttctgcttctgttgtgtttttggaaggttagtgttatatatcagcttccaagaagttttggaagaggcttgggaagatgaagctggtctaacagctccctatgctttgaaactgttttccttctatgtaacatgcttaggattcatcgtttttgtagattatgagtagttttgtatccttttgcaagaacagggttttatggtagagaaattagatttcaggctttcttacatgaggagagagttttatgcagtcattagagcaatatccttaacacttgaaatgagaaataaaagtgtgcacagttgttgaactgcaaaacttagagaatcttttgatcctttttgggatgttgagacttagccaaacatataagatgatattacctgtggaaaaagtgccatcgaaacagttactgtttttgttgtgtgcagacctagtctatggcataacgttcaaaatcggagaccctgaggctgtttctttggtttctctgagaccttgatttctcttagtaagtattggctgccctggaagacttcgagttctgttagagaatg

SEQ ID NO: 10367 - DNA, 1046 bp, Homo sapiens
gtttgcggaaaggaacatttcttcttagtttttacttcttgcaaccatgaagccatacattgggaagtatttttgtttgttttgtgtttttttgttgttgttggaaagagagtttctctatgctgcttacattggttttgaattgctgggtttacaggcttgagccgccatgtccagctcagggagggtttttctttttttttttaaatcccagggaaggtgattgactcagggttgcttttcagcagtacttatggcagcgaacctgacccccaatccccgggaggtcctccaggttctcctgacgcttggttgttcccttgccctttggtgcatgtgggtttaacaacctgtctttctcttctaggtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagt

SEQ ID NO: 10368 - DNA, 1134 bp, Homo sapiens
gctgtgtcccgtgcccagtggagtgctggaggggtgcggggggaagcagaagcctgcttggggggctgggctggggcctgggtgtttgcatttttagctcaaacatttctggggagaggcccgcccaccgcctcaacactgggctcctagggccgggcgcggtggctcacgcctgtgatcccagctctttgggaggccgaggcgggcagatcacgaggtcaggagatcgaggccatcctggctaacacggtgaaaccccatctctactaaaaatacaaaaaaattagccaggcatggtggcgggcgcctgtagtcccaactactcgggaggctgaggcaggagaatggcatgaacctggggggcggagcttgcgttgagtcgagatcgtgccactgcactccagcctgggcaacagagcaagactccgtctcaaacaaaacaaaacaaaacaaaacaaaaactgggctcctagcagggggcacacacaccaccaagctcttccagctgctttcccccgcgggtttcaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgagtgctgggccctggtgctggatgggtggcgttcgctggctgaagcaggaatgggctctgcggtctggatctggggcagctcagagttgacggaaggtggatcagcgcggggtggggaggttgagggaagctggatcagcgtggggtggggaggttgagggctggatcagcgtggggtggggaggttgagttaagctggatcagcgtggggtgggaaatgctggcagggacacaggtgaggctgcaccctgagcttgcactgatgccccaggaaggacctcttgataagacttgggcttttttttttttaaatatatattttttagagactgtcttgctctgtcacccaggctggagtgcagtggtgcagtcacagctcactgcagcctcaacctcctgggctcaagcaatcctcctgcctcagcctcgcaagtagctgagaccacaggcatccac

SEQ ID NO: 10369 - DNA, 1924 bp, Homo sapiens
caccacacacaactaaaggttataacagatgtgaaattggcgtaggtcattctggaagctgcacacattagcaggatgttttgtagagccatcttcacacaaaataaggtttgcttttttctgcatagagtaccttatttgcttttaggacattacaagagagcacaaagcagtgatctgcatgctaaggaggacatggagagcctggagccacagaactgagtggctggaggccagggtccagcacagagcaaagttgggcaccccctgcccagttcaaatgaggaaaccctccgggggaacgcgtctcgggctaggggcgttgcacagagtggggactgagtgtcactgggcatgaggttgtcagaggaaagaacggggacccctgtggctcagggagagcctcccgttcagcgctagggagcccacgaggggcatcgagatgatgtcatcaccaatgtgtttccattccagatcgggcccgggacacccagacagatgagattgtcgcactgaagaaggtgcggatggacaaggagaaggatggtgagcaggaaattggggtgttgggacctcgcactgggaggaggcagaaggatgtgagttacctgaagtttcctcagagcgactgcacggtgcttgtagcgggggccggcctctgggagggttctggtgtggcccagcacatcacccccaggtccacacgcagcctcagctgtctgccaggagggctctgcagtctccatcccctcctccccctcctgtctggtgaggccacctcactgcaggctcagctctgctgtcccctccacccccagcacctgcctgtgcaggcagggccctgccatgccccacatagatgtccacggtgtttagagaggtgccgattcgtatttggtcaaggaagagttaaaagtgcttattgggccgggcatggtggctcatgcctgtaatcccagcactttgggaggccgaggcaggcggatcacctgaggtcggcagttcaagaccagcctgaccaacatggagaaaccccatctctactaaaaatacaaaattagccaggcgtggtggcacatgcctgtaatcccagctactagggaggctgaggcaggagaattgcttgaacccgggaggcagaggttgcggtgagccgagatggtgccattgcactccagcctgggcaacgagcgaaactccgtctcaaaaaaaaaaaaatgcttattggggtcgccccaattctccctgaggtggggacactgcagcacctgctatcaggtgttcgtgaagcccaagagtggctggggttggggcttccccgccatcactggggtggggctcgctgaggccacctccctccccaggcatccccatcagcagcttgcgggagatcacgctgctgctccgcctgcgtcatccgaacatcgtggagctgaaggaggtggttgtggggaaccacctggagaggtacgtggtctcctggtctgcacattgggccctagggagcatgtgtcttgggctagaggtgttgcacagagcgaggactgagtgtcactgggcatgaggttgtcagagaagagatgaccccacctcaccgcctggctcagcccattgtctgagggggacacaggttgtcctgcccatgtcccctcctgcagcaggggaggctccacttccaccccttaggagaaggccggagagtggcatgcatcttctgtttcttccagcatcttcctggtgatgggttactgtgagcaggacctggccagcctcctggagaatatgccaacacccttctcggaggctcaggtgcgtggcagaggggcctggggtgggggaatgggcttcatgggcccttgtggtgcacatttataacgaaacagggcacttggggacttgaagagctgctgctgcctctgcctcc

SEQ ID NO: 10370 - DNA, 1295 bp, Homo sapiens
gatctcaaactgctgggcttaagcgatcctcctgaagtgctatgattgcagatgtgaaccgtcatgcccagcttatttaaagtctcttaaaccacagcattgtttcattaatttcctaccaattttttaaccagccagaaaactcagacaccacactggggccagagccaggcagtcctttgttctctgttgtaggagggaatgcctgatccacagggccaggcatgggcaactgaggaaaatgaggcctcttcttccaaaatgtaggcagctggggcccaagagcacagggcaaggtagacaggaccaggccagctgcctgctcagtcagcagctctcagaacgccaggatgctgtgggggcagcaccagcacctgcccacactctcacgtggacctgggggatgcagacctagtttctgatggtcctgaaacccttctctgtcctctgatggaaaggcaggccccaaaggtgacaggtgggaataaggacttggtttctatggcgtggttgtatggttgtaaggccctgcaatgaccccgttctctctgtcccagtttcctctcccctgaggctgcctccccagcacccaacccggactggctctcagctgctgcactgcactttgcgattcaacaagtcagggaagaaaacatcaggaagcagctaaagaagctggactgcgagagagaggaggcaagataggaaattcttttactgatttattttctcgcaagcttggtttcaatcagtgctatttctctgggcttgtctgatgaactgtttttctaaagacaaatatgtggcttggagcaagactttttttttttttttttttttttgtatttttagtagagacggggtttcactgtgttagccaggatggtctcgatctcctgaccccgtgatcctcccgccttggcctcccaaagtgctgggattacaggcgtgagccaccacgcccagctggcttggagtaagactttgactatcaagtttactagtaaaaataataatttcagttttttaaatggttgtatgtagttgagacagggtctcactgtcgcccaggctggagtgcagtggtgcagtcagctcactgcagcctcttctgggctcaagccatcctcttacctcagcctctggagtagctcagactacaggtgtgtgccaccatgcccggctaattttgtaattttttctgagatgggggtctgtagtccaggcatggtggctcatgcctgtaatcccaacacttagggaggccgaggcaggcggatcacttggtgtcagga

SEQ ID NO: 10371 - DNA, 1252 bp, Homo sapiens
gggactacaggcacccgccaccatgcccagctaatttttttgtattttttagtagcgacagggtttcaccatgttagccaggatggtctccatctcctgacctcgtgatcctcctgccttggcctcccaaagtgctgggattacaggcatgagccaccacgcccagctgttttttcttaattgataagtagttgataagtagtactgtaactcctgggctcaaggaatctgcctgcctcggcctcccaaagtgctggcattacagacgtgagccacagcacccggcctgcactgttctatatttgcaatttcaaagtgatttccaattgaaatagcttgccccacttgttccttcttgccctgtccactgtggagacctctccctgacccctgacgtctgggtccccgactggctgggcagtgagccccgaggccttcctgtgccagcatactgctctttttcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggtaacacctactaccacctgggcagggcagcaccacctgggcagggcagcatctcatgacggtcctagaggttctttgtagtgagtttgtttcccgttacttacttgtctgtgtgtccccaccccaagcctgtccatttctgtggcacatgccacggagaagaggatctggagggttgaaagtacttttgattaaaaccttccagccaagcgaggtggttcatgcctgtaatcctagcattttgggaggctgaggtgagtggatcacctgaggtcaggagtttgagaccagcctgaccaacatggcgaaacgccatgtctactaaaaatacaaaaaaaatacaaaaaaatttagctaggtgtggtggcgggcacctgtaatcccagctactcgggagactgaggcaggagagtggtgtgaacctgggaggcagaggtttcagtgagccgagatcacgccattgcacaccagcctgggcaacagagcgagactctgtctcaacaacaacaacaaaaccttcctgctcagacgtggagggacgtcgcagaaggagctcttgtgaaagtagggaaaagtgttcagaaatgcccacggcggctgcatttataagaagc

SEQ ID NO: 10372 - DNA, 1163 bp, Homo sapiens
cccagaacatcgtgttctctcacacagatggcccaggaaaccttagtcccttccattccttcctcatcttcatggacagagctggcctcagtccctgttgtgactgtttgaggccctggtgtgctgggctcttctctcaggcttggcacgaccctctgggggagttccgtgtcacagagggtgccgctgaggccccgtcgggttggctcccggggctccactcccgggtgcggcgcggcctgcccttcccaacctgtttccttctgctccactcccgggtgtggcgcggcctgcccttccccacctgtttccttctgctccttcgcttctctgctccgtgggtttcgccgttgccttgccccctttctcgttgaactgccacctccttggattcagtttcaagtctgtggttatagtggcctggccaagaaagccccttccttgcttaaagaagggatgagcctgagccacagtttgtgctgggattggtgggtggcgtgcaaggcaccctccctttcctgacccctctttctgctgcattggcaggttcggagtgttcagtggacacacgcttggcagtgtaatttccacagatcctctgaagaggttcttcagtcataccctgactcagatactcactcacagccctgtgctgaaaggtaggcccagtgtggaggctgctcagttgctacccattttggggattgctgttgccttgttgccttggtaacgctgactggagatgccaggaattctaggacctcttttacgtctgtcttgaaccagagactgggtcctcagatgcctgagattgttactaaatatccttttacctgaaagcaacagatttttataagaaaattcagaattatgagtggacaaaataattgtcattaaaatagaaatatcttttttgtttgtttgtttgagtcagagtctcactcacttgcccatgctggagtgcagtggcgtgatctcagctcactgcaacctctgcctcccaggttcaagcaattctcgtgtctcagcctctcaagtagctgggactacaggcgccaaccaccacacccggttaattttttgtatttttagtagagactgggtttcaccatgttggccaggctggcctcgaactcctgaccttcggtgctccacctgccttg

SEQ ID NO: 10373 - DNA, 1103 bp, Homo sapiens
cctatcattttcattaggaaaagtttgtaggttgatgggtccttggtgcctttttttcctgcctgctgctggagaggagctgaggcttgaggagaaaggaggaagaaggaactttaatgcattggctgaatatatatatttaacgttttgtcctgcagatggtcctctgtaaatggagtaaattacaatatttgaggagtcttccttacctcatctctgaaggcagagataccccatagcctcggggccccggctttctgtagagctgctgacaaagtccccctgagccagagctgagtcactgctgtgtccaacagtctcgggttcttgcatctttcccgtccagcgtctcgcactgaccctgggggtccccaacgcaagcccgttcacatctcactattcatatctcagcatgagcgttcacactgtaagtaacgccctggctcttctccaacctgtttttccagataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcaggtggggggctgagtggtgaggaggtggcatcagacgggagagttccaaggcacccagccacgtgtatcctgtgctgtgattttccttggaggtgtaattttccgagttccattttggttacctgctagttgcccccaaatttacttgggaaccttgatgagatttgcatgaaatgagtgaaggtcgcaggcctttctcctgcatctcaggagagtctgcgcctgcccagcagtgtatgtaaccgcacacgtgtgtccctcctagccaaccgcgcacgtgtgtccctcctagccgaccgcgcacgtgtgtgcctcctagccgaccgcgcacgtgtgtccttcctaactgtgccccgaacgtttgcttggctgggttgtggatctgggtgctggtgtaagtgaactttgaagaaacatgcaggtcaggttaacgtgggatgggcagagatgcagacagcctgctgctgtgctccac

SEQ ID NO: 10374 - DNA, 1099 bp, Homo sapiens
tgagccaccacgccccgccctctggcttttatttacaatgaagttttcaaggttcatcctcactgtagcgtcgatcagaacgtcgttcgtttttatggcttagtaatactccactgtgtggacggaccacatgttgtgtatccatcattagttgacggccgtgtgggctgttgtaaataatagtgcttacgtcagcatgcacacgcagtcttaggtggacacatctgtgctgcacacatggacgcctggttctgtcaggacgtggcagcagttgtgcctcatggtgttgaaagtgttaccatgtcaagctcacaagttctgtggttgaaataaatgcagcgtggcatccagggtgcccaggggcatgtctgccctctcagtgtccaggactctagtttcgtgaccttccgtccagacctttccttgttgtccattatcagaggaggggccgtggttgctgtgtgtggccatgacaccctcccctggcgtccctgtgcccacagagagagcgctgtacagcatggaatgtgcgttccaccccctgttcagtctcaccagtggggcctgccggctggattaccgcagacccgagaacaggtgagtgcagctgccctggaggtgacgcagctccccttcccttctcctgcgagtgaggctgggggaggtgcagtgggcacctcatggctgccctccagggtggaccagggcccacaggtccagagtgacccaccttcctctctctgggcttaaggatagagggatgggattgtctcagcccaggtttacctttgtctgtggacatgcctgatgctactgtggaggtcagagtgggaggtctgctgagcccaggagttcaagtccagcctgggcaccatagtgagacccccatctcttaaaaaaataaaaataaaaataaatgtttgtgttagaagtgagcctggctgggcacagtggttcacgcctgtaatcccagcactttgggaggccgaggtgggagggttgcttgagcccaggtgtcaagaccagtctgagcaccgtggcaacatgcagtctcaaaacagcattttttttttttttttttttttgagacggagtctca

SEQ ID NO: 10375 - DNA, 1169 bp, Homo sapiens
ccagagagcagaatgggggtggagcgggtgctgaccggggcgctaagcagtgtgtggggtggagcgggtgctgactggggcgctgagcagtgtgtggggtggagcgggtgttgactggggcgctgagcagtgtgtggggtggagcgggtgttgactggggcgctgagcagtgtgtggggtggaatgggtggtactggccaggacgctgagcagagggcggggtggagtgggtgctggccggggcgctgagcagagagcattctcctttgtgtcgttgtaattcatgtggaactattttggatctaggagcttctacctggccctctacaagcagatgagcttcctggagaagcgaggctgcccgcgcacggcgctggagtactgcaagctcatcctgaggtgagtgtctgctcagggccaagcccgtccacgctccctgtcctggctgcaggcccactctcagcctgacgatgcccctgttcccctttgctctgctctctgtgctgcctccggaagtctcgagccggatgaggaccccctctgcatgctgctgctcatcgaccacctggccttgcgggcccggaactacgagtacctgatccgcctcttccaggagtgggaggtgggtgcgagcctggtgaggccccgtggagggacggacacctgcttctccttctgttttcttggttcagtatctgtgcgctcaggggacgtttggggatgaaacgataatcgtctgagggcagaaccacgtcctcctgccttgtttgtctcccttgccgcctctacggagtggaatgtggttttcctagggacagtacagcagccttatgtcagaatcctcatacgtgtgtacacatgctcaaacgtgtgtacacatgcacacgtgtgcctgcaaggactgtgatgctggtaatgatgaaaaaccgacaactcccgagctcctcatgggcagttcaggaagatgcagccgggaggtagaaggagggttggttgcgtggggctgacacagggacccccagcacgtctgtcctgttccatgggaagagtgtgagtacagcaggagagacttgagctctgtccccagtaactctaacacagacacgtgttggaatgataatttcggtgtattgggttagatataacgtattaatctcacctgttttgtc

SEQ ID NO: 10376 - DNA, 1118 bp, Homo sapiens
ctttgcttggggcccaggaaggaggaacccatttctgagaggtgtgtctcacatagcaggtggatagcaagctagagcggggctgagtgagtatctggggctgaggcccagagaggatcccataggtagctctagggctggagctctgcaacattgggcaagaggaccctgtgctgggaggcagggagcttgggcccctcagatgggccacgtgccctcgtgggaccctcattgtcaccgtgagctctttccaaggggacgccaccagtgggggcctgggcaggaggcagctgaggtgtttcaggaaaaggctgaagatcaaggctgtggtgtgaggactacccactttagggaagtgaaagaggccagcctcaccccagacaccccagtgtggttggggaaagggggtggtccgtggtgagcctggtacctggggactcatcctggccctgcctggccctcaggtgggatgctatggaatatgatgagaagctggcccgtttccggcaggcccacctcaaccccttcaacaagcagtctgggccgagacagcatgagcagggccctggggaggaggtcccggacgtcactcctgaaggtgggtgctggtgggagtcagggtgggagctgggcaggtctctgactgcttacgtggacccctcctttcttcctgccgcgtcctgcgcagccctggctttcccacggagccggcacctgctggctgtgttctttttcccatctcttctgtggtcgtgtggtttgtttctgtgtccccactagaattcacattcctgagggcaagatttgtgcctgacccatcactgctgcatcctagggcccagcacatagtaggtgctcagggaacacttgctgagtgcggtcagcgctgagacctggtaagggagaggttagccgagggaacgtgctctgggcgtcagggtggcatgagctttagaaactgcagatgaggtcatcagggagtgcttggagcggggcagctgcagagacggcctggagtcgacactggggttcgtggattttgctgtgtagccatgcagtggtttttctctcgcccccgtggtcacgcatgaggtgtccaccttagaaatgggatgtct

SEQ ID NO: 10377 - DNA, 2143 bp, Homo sapiens
ccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatcctttagcctggtgtgtgtgtggtgaattgcggacaaagtaagagaaattggtc

SEQ ID NO: 10378 - DNA, 1099 bp, Homo sapiens
agatcactatgggggctcaggacgacctgaggaaggtcacccagagtgcctacgcccaggtaagggtgggcatcccccggcacgggccgcaggaggctctgttgggcgcaggctcatcctgggttccgcactggcaggttgtgcagtttggggtgagtgagaagctgggccaggtgtccttcgacttttcccgacacggcaagaccctggtggagaagctgtacggcgaggcaagcgcccagctccttgatgacgaggtccggcacctcgtcagtgccacctacaggtgcaccctggacctgctgacacggtgccgggagcatgtggagaaggtgagtgtggcctctgcccagacaggtcgtgggtcccatgttgagtcacggtcatgccacacccgaaggccacacccgtccttcagcttgcttaggtttgggctgtgatcatgtcctcagagccgtctgacaggtgggccgttgtttccaggtgggccagcggctcctggagaaggaagtactggagaaggcagacatggtggagctgctgggcccccggcccttctcggagaagtctacctatgaggagtttgtagagggcgtgggcagcctggaggaggacacatcccttcccgaggggctgaagggttggaaccgcggacaggaggaggaagatgtggagagcagcctgtgcagggggctctgtgtagcctgtggcggtcgcctgcacctgctgctgggtggagttggggtgactgccacttacctggggccttggcaaagcagctgcggaatctcacccaaaacaaattaaaacgtgacaactgtgaatgggtgttttagatgagggtgctctgagcccacatgcagggagtaggagtgggagtgggcagagggggtaccctgagtccctgggccctcccgctggaggacagtcgggtccaggcttagacgggagaggccccagggctctggcccctgtggtgctgaggaaggcacgactgtagcttcgagaggggcttgcgtgggacaccttggagacaccaggccttcctggggcctccgtggaggagcgttgatatggtcataaagacactcggaggagc

SEQ ID NO: 10379 - DNA, 1189 bp, Homo sapiens
gacaatgcccctctcatatccttaactgaaattcctaaataacgtaacctatctctacctattgttaaaagcagtcaggatattgccctcaccgtagtgcagagggggaagtaatgaagtgtgttctggtttgtaaaagctcagatggaaccgcagtgagggccgtgatgtggctggagtggataggtgtcatagtcactgcctgcgacaggtggataggtgtcatcgtcactgcatgctggcagtgacaggattttctacagtagacaacggcccttggtggaatcttgaacaaagtatagtccttcagtctgcatggaagctgcattcccagaaaactcagaataagttgaagctgcagaaatactgtttatacatagaagacgtctaggtgccagcatgcctgaggctggcagcagctggtgatgggcaggagagcacccagctctcaccatgcaggccacagcccctttggttctgcctgctgagcccctgccgggcctgtgcttgtgcctgcaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgcttgtgagtttcccgctggattcctctccctccttggcatgagcttgcctaggctcaggagggaggagcatcacagggaggggcttggcccttagggcaggaagggagacggggaggcctgcatttctcctttctctgcctcgtgttctcctggggaaagtaaagtctgggggtgttttggagacaaggccctcatcttcaccacgtgctaccggccggccttggtgagactcagctgcttgtgtcctggaaccaggtctttctggcgattatttttggccttgccatctcccaggagcccgtgttacttggatgactgtgaatcttgaatactttctgtcccctactccctgtttttcctccagtgcacaaaagcccgtttgaaagtcagggagaaagagctgaaagacctgcagtgggagcatgaagtgttagagcagcgattcaccaaggtgagtggcaccacgctggccctgcagttggcggtgggtgttagagcaacggt

SEQ ID NO: 10380 - DNA, 1118 bp, Homo sapiens
tcggtccacgggacagccactggccaggctagctgccgcctcactccgcagccttctgtggctaaatggcaggacggacacacaggaatgggctttggaccacaagctctggcatatcgggaggcaaagcactcaagtactctgcagtctagatgacacatttcatggtttggaggacagaagtaggtttccacatcacatgaaaaggacagtgtcacagtggggttacccagtaaacagctaccaaagccatcatttcacgcttccctgtagttttatgagctcgccctctgcatgtggatatggggaaagccgggcatgaaggggtgtgtgaaaaagaacagcctctgtgactgactgcagtaagctcacaagtttgtcactgtcagacttagcaagtcagcctgcaaaggttgtgctgatctcttggccacactacctactcaggttcccatccatgcctcctgcctgcccccacccccagccccaccagtgagacttctgattggaagtctatagacataagaattcaactctgacccatggatgagaggatgaggcaaagaaccaatgggttatctagtaaacgatcaataactacctacccacaatgattgtcccaggccaatgtcacaagacgacattacttccaagaaccaagtcatcccttgcttctgcgggcccagtgccacgggtactgtcctgagtggtttggaaggtgggtagccgctgatacagggacaggcagatgtgcagacacttaccaccctggtccaccgatcccaccccatgcttccacctcccagagctcttgagataagaccttaagaaggatccttgggcttgcattaaaaccactttgctgtccgtggaggtctgacaggacccaatagttgttactacaaaagtgcttttgcaaatagggcaagttagaagaaggaggtaatatgaatattctttagaaaaactcaaatccatcggcttatcaatacccaaagtctgaggctacccagggcacaatttggtccatggaatgctgagtggaggaggcagctggtgtgaggctgcgcctgactcccaggagcatttagccatcctttttggcttggggagtgtca

SEQ ID NO: 10381 - DNA, 1211 bp, Homo sapiens
tcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtgattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagcc

SEQ ID NO: 10382 - DNA, 1718 bp, Homo sapiens
acattgagttgtactgcgcatcagtttttttcattctgttgaccaataaatactttcaggaccataatcccttcttggcttaggcatctcaggtgtcaaggatgatagaagtcctttgcctgcgtttaataccaattgtagcaagtagaagagtctttatgcttggaatgacacctttgtttgtggctgccatagcctaatgtagtcaatacgaaataattgactttttttcttttttaacaggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtacaaggtgtaattatggatcattttctagcatagtatttcatacaaccaaataaggctgaatgtcttataataattcttagaggtaaaaactgtgtgccctcttcctccagaggctagtggcagtagtggagaattactcaatcctttcttagtaatccatacacacattatagacagcaggatagcagtctccctttccagaaacactgtataagaagcttctttccataaacagtttatacatcaatgt

SEQ ID NO: 10383 - DNA, 1906 bp, Homo sapiens
actaaaggaattgcctggtgaatgttgttaaggatgtgagtgctgaaggcaaactgcctgggtttaaattttgattctgtcccttgcagcctgcctgggttcaaatcctagctctgcttattaaattcttatttaattgttgatcttagagcaatgtctttacgttgctaccttgtgaaagaaggtaattcatgtaattgaccagcatttaccaagaagcatcagtgttcagttttagtcattggtaattctgtagctgtactgtggtactgtgaagggggtgtgggggctggcgtgtgtgcgtgcctgcatgtgtgtgtgtaacaataggcagcatgcagaagggaaaagatactttttataacctagaggcagcttttctctgcttttgtgtcaagaaggaagaagggagtttggagagggatacaaattctttttaatactaagctctctacctcaaaaccagagatagaatatgtaataatttgtagaatttctagacttaatctgatttaaaaaaaatttttttttttttaggttgagactgagctaaagttaatctgttgtgacattctggatgtactggacaaacacctcattccagcagctaacactggcgagtccaaggttttctattataaaatgtaggttctatactagaagggaaaatgtaagattgaaagttggtccttttagaaccataactttgttctatgtaggttttcaacttttatttaagaataattgttcaatgttagaaggatagttaatattgtaatgaaaaggtggttgggctattatgaaaatgtattagcttttgcttatttatattcttttgtttttgtgagacctatcccattcccctcccccaaacggcatacatttcacagtgcttagtgttatatatagacattttattttatgattaataaactgtcatgccattccttggaaccacttgcttgtttaattctggtctatcaggtgataattttattaatttttagaggctcctcagttaatttcctgggatttttgcttatatttagtaatatgaaatgtctaaggaaaaaaatgaaacgaagccagttattcctgagagtgtttaaaattattgaagtacacctaattgttacatatatttttgtcacattttatataatatagaacaattttagcttattttcctttaaaaatcgttcctagtttaaattttttttttttttttaattttggttttgttttaggaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggtaagttgtggggaagaacagcagcgctcagcgtgaaagttaaggggggcgctgtttgggttttccgtgttgtttcttgggcctgtctttgtagacttggctgcatagtaattcttttggctcttactgaaactactttggatagtattaaaacagacctgtctcaacccactagcatagcagtcagcataattattttgatgtgggatatttttgttgctggtagattgaaatctaacatgttaaaatgagtagaggaaggaaatgagaggaattagaattattttaatttttgttatattagttttcagtctttttttaaatttgagaccatgtctcactctgtctcccaggctagagtgcagtggcgccatctcagatcactgcagccttcacctcctgggttcaagtgattctcctgtctcagcctcctgagtaactggagttacagg

SEQ ID NO: 10384 - DNA, 1107 bp, Homo sapiens
ccatatactccgtatatttttgctgtatgaacaaattccccttccttttgtatttttggaaatactatttatttgtgagacaatacattttagaacctgtaaattcttaatctttctcttaaactgacagctcatttttttttgctggaaaatagttaggtgtgcctaattaccttatttaatgagaggtgctttcagaccacactaaattatattagatagtatatgaagtctttctcactccacctaactaccttctggagtctttgtattggctcttagtttggtttcctttacatgtttttggctttttactcatattagttttgatgattatgaaattatttttgttaaaatgtttttttcgcagtagcttgacagaaaaaaactactttgaaaggaatatgttaagaaaacttcaaatttgtaaggtctgacttttccttttcccatacagaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggtgagattgttgtgccatcatccccccttatccacagtttgagttacctgtaggacggtacacttaagattttgagagaaaaggagactacattcatataacttgtattacagtatgttataatgtttctgatattgatctttgtgcctggtttataagttaaacttacccgtggctatgcatgaggacaaaacatagtctgtatcaggtttggtattttccatggtttcatcacatccactggcaggtctcaatggatccctcttggataagggggaactattgtattttcaagcaaaatgatgactgttttttaaaaaaatatggtgggttggccaggcgcggtggctcaggcctgtaatcccagcactttgggaggctgaggtgggcggatcacgaggtcaggagatcgagaccatcctggctaacatggtgaaaccccgtctctac

SEQ ID NO: 10385 - DNA, 1433 bp, Homo sapiens
tcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatg

SEQ ID NO: 10386 - DNA, 1834 bp, Homo sapiens
tgagcccaggagtccaagaccagcctggacaatatagcgagaccccattctccataaaaaggaaaaaacaaggacgaaaagaaaagtctgagtaccggggcccccgtctgctcccctcaccacttggccgtctctctccgcccccacaggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaatgtggtctccttatgaatattaggaaacgaagagggccccggaaggcaaccaagggcctcgtgttgcaggtttttctcgagacagtctcgttcttgtcacccaggctggagtgtagtg

SEQ ID NO: 10387 - DNA, 2166 bp, Homo sapiens
catgttgtcacttttccccaagccccctccttccgttaactctcggtgctggtttcccagtgccctgtacaccacccgagtcatgggattccagcagctcaaagcagtcttaatcactgaatgaaaaacctggctctgctcccaattagcctcagagagaaaattatttttacaaataaaagctggcctctaaccctacgggcaaggagggccagggtctcaccaggagtgacggcaggccctgcttactctccctgccccatgttcccaaagcagcctcggggaggctggagggtggaatgaggcggactgctgtgatgccagcttctcagtcactgctctgggcctcagtgctctcccccactcccttccccacccacccactggcttccctcctcctcttgaaattatccattcaggacgatttacagtgtttctgttttctcctcttgcttccttaatactttcatttttcttctagttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttg

SEQ ID NO: 10388 - DNA, 2205 bp, Homo sapiens
actgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccatgccaagatcatggctgacaacccatcttgggatggcgagaagaccattatcatcacatgcaggtgggcctgggctccttgggaggaagtatggtggggcagggattgcaggccagggcccagaacagtggcctgagctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatcgccctttgcacttggggcctggctggcttggaggtggcgcaggctgcatgaggcaggagccctgttaacattggctgtttccttctccccgaaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggct

SEQ ID NO: 10389 - DNA, 2205 bp, Homo sapiens; identical to SEQ ID NO: 10388

SEQ ID NO: 10390 - DNA, 1187 bp, Homo sapiens
gtagtcccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtggg

SEQ ID NO: 10391 - DNA, 1099 bp, Homo sapiens
gggctgtatctgtccagccagtttctcttcctttacatttatagcatgtttcatcttacattcagtccaggatcttagtagcccaaacccctgatgctcatctccaaatctgtgttttgcttgtatttttctttctagaatgaactcccctctttgctctgttaatcacagtccctccttaagacacgtttttttgtgcagcttttttctgatcctagtagccttaatttcttttgttcctgaactctgtaaaacagtgtatagtttagcacatactcatgtgtcagcttgtggtattgtcttgttgaaaggggctgtcagcctggtcattggacacggccatttgatactctttgtaccttctaagtgcctaacatttaacatcagtgttcaatagaaacgtagttggattatttcaaaactaggatattctgttctagttgatctgggagggtagagactaaatttccattttcttctctcttgcttttaagttggctaagtggaagacagctgaggaggtggccgccctgatccgatctctgcctgtggaggagcagcccaagcagatcattgtcaccaggaagggcatgctggacccactggaggtaagagggtggggtggggtaggagaaaagagaccttgagaccttcaggctgtttctcatcttggacttgatcttgtcttaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggtatgaacctcgggaagagaagatcgctggaggaggagcgggtttagggttaggagaagatcctgtgtcaggtttttgccattttcacatttttagcctatagattgggtgggaactctgttgactttcatgagagtttaagaccttaaagttaaaaatcaactcttggggccgggcgtggtggctcacgcccgtaatcccagcactttgggaggctgagttgggtgaatcacct

SEQ ID NO: 10392 - DNA, 1133 bp, Homo sapiens
gagctcacttgtggcagaagatccatgagagcattgttatggacttatgtcaggtgggctggaatcgaggggagagggtactgtagagagtcagctcaggtggaattgaggggagagggtactgtacagagtcagctcaggtggaatcgaggggagagggtactgtacagagtcagctcaggtggaatcgtggggagagggtactgtagagagtcagctcaggtggaatcgcagggagagggtgctgtacagagtcagcttaggtggaatcgcggggagagggtgctgtacagagtcagctcaggtggaatcgcggggagagcgtgctgtacagagtcagctcagcttgctcttttgcatatgggaaatccaccctggaagctctgaggatgagactcctattgcctcattatcttattgtacaaactctgattttaattgggcttccttaacaagtcttaatctctccatgttttccttcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaagtaagtgcctcaggacccagccctaggcagccaggacactttcgttttcctgttcttctagccctgcaactttaggaattgtcctgtctgcctttgtttcaaacttggagccagtgctacgcttggagcctgtcaacacccttagtcagatctgctgattctctggggtcctgctgacctggaacaagttggtggagtgggtgggatggttttgggatttaagtggttctggttctggggacattggttatgcccatggtttcttagaagcttgaaccctcttcatcctcagggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacaggtgag

SEQ ID NO: 10393 - DNA, 1191 bp, Homo sapiens
actcaaatctttctttagtagtagggataaaactaactgcatcaagtagtctccaccctccccgcccctggctcatctgtaatttacttttttttctactacctttagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtacagcctggttcaacgtatttctaaaccctattgctcaggccctaagggaagtgggtatttctttagttttaggctttattttttctgtaatcttggttgtacacccaaacaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacaggtgggcacctaggagggcatgccaaccctggggcaggggcagtggtggcctttgaaccgtgtggagttcagggtcagagcatgccatggttgtatggaggtgagaaggctggttctactgaccctaattatttttggccaggaaggagtgctgagctcctcatatgagatcacgttttgacttgaatctttctttttttggaagacgcctgactttagaagacctagaagattcatgggatcgtggcattcctcgaatcaataccctcttccagaaggaccggcacacactggcttatgataagggctggcgtgtcagaactgactttaagcagtatcaggtatgtagagggagcagattttccctgagtcaggaaaatccatggctatccccgaaacttggggcaataggcacccagaagcttgaccgtgcctgccttgccatctaggttttgaagcagaatccgttctggtggacacaccagcggcatgatgggaagctctggaacctgaacaactaccgtacagacatgatccaggc

SEQ ID NO: 10394 - DNA, 1079 bp, Homo sapiens
tggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgagtggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaaggtacagggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctccttcttgtggacttgtgatgattctaaattaaggcaagagtaaaagttggatttattattttgaacagaaaagcattatttttgcattttctcaggtgcttatctaagtcatgttaaccagtggcatagagaacctgtgaaaaagcagccctcataggcatctcggggttcgtttctccttcacttaccttcagaggcccagccgaaggcaaccggaattgagaaagaaaaat

SEQ ID NO: 10395 - DNA, 3265 bp, Homo sapiens
actcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtgggtgtctctttatttccttggaggcgtaaacatccgtctttagggtaggattaccacttcgggaatcattagggggctatctggctccaatctcttttcttttcccttttagacagggaaaagaagcaccatgttgcttaggctggcctcaagctcctgagctcaagcgatcctccttagcctcctgagtagccgggactacagatgtgtgccacagtgcctggctggatcctggcttgattgtgctttttggacttttaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggttgggcagagtaggctgggctgggtgtgagtggtgggggagtgggcaagagggaggactgtagagttgtgactgaaccttgttctggcaggatcgggctgtagcgggaggctaatttcatgtccaccttacaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttataggtgagtagtagggtagataggttcctgctgggaaggtgacagcagggaatggcgtcatcctcagagtccaaagaaagaaggtgtagccccagtctttcctggttttacttcctcctagttttcccattcacccttcccattgcttttgtcagtgtgaagtctcggttgaaccagtctcagagggaggagctaggtctgatcgagcaggcctacgataacccccacgaggcgctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggtagaactttcatgagatcgccctgtgaggaacggggcaggaatttagttctacgtcaaaaatctcatctgggtagcatgattggtttactctcttgatgcgtggtagtaaagggaagtagtgttcgtgttaaactgaggaaaagcccatagtcaaagcaatccaaatgaatacgtggaatcatagtgggattggttatggaaggtaatgatagttcctgtggggctagtcttgcaagaggatttctaacctgctggagacctgccttgctactcctcaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggtgcgtctcaggcgcagtagcatggaattgtgtgtggagtgcttgtctggcccactgactcagaatttgctgaggaggaggctgggtgcggtggctcatgcctgtaatcccagcactttgggaggctgaggcgggcagatcacgaggtcaggagttcgagaccagtctggccaacatggtgaaaccccgtctctacttaaaaaaatacaaaaattagttgggtgtggtggtgggcgcctgtaatcccagctacttgggaggctgaggcaggagaatcacttgaacccgggaagtggaggttgcagtgagctgagattgcgccagtgcactctcagcctgggtgactgagcacaactccgcctcgggagtggaaaaaagtagaatttgctgaggggagaacaaaagaggttaactctggagaatcctggggcatggctcacattcttaagaattgtagttctttctttctaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggtgagggctttcctggattcctagccttgcagggtactgaggcatgtgctttgcctctgaaatcagctattgtacctgagttgacttaactgctgttggggctttaaaatggaatgaagcggccgggtgcggtagctcacgcctgtaatcccagcactttgggaggccgaggcaggcggatcacgaggtcaggagatcgagaccatcctggctaacacagtgaaaccccgtctctactaaaaatacaaaaaattagctgggcgtggtggcgggtgcctgtagtcccagctactccggaggctgaggctggagaagggcgtgaacctgggaggcggagcttgcagtgagccgggattgcgccgctgcgctccagcctggggaaagagcgagactgtctcaaaaaataaataaataaaaataaaatggaatgaagcccggggagggtgggggtaggatggggtggggtctccgtctattgagctggaggacttgtgggtgtcccaaatctcagtgtactggggcctcagcagtgtacctggt

SEQ ID NO: 10396 - DNA, 1119 bp, Homo sapiens
ttgccgccagggctacaacatgctcaaccttctcattcaccgcaaaaacctcaactacctgcacctggactacaacttcaacctcaagcctgtgaaaacgctcaccaccaaggtgcctgcattggaccctaggggcctcctgggcttcaaggacggacagttgttttcctctggttactgatgaaggcatacatcagttgggtccattgctcattcacgttctgtctgttttttgcatcttctccaggaaagaaagaaatctcgttttgggaatgctttccacctgtgtcgggaagttctgcgtttgactaagctggtggtggatagtcacgtgcagtatcggctgggcaatgtggatgccttccaggtaaggttaggtattcccaacccctgcctgggtgaggacgctggaggaagcctgtgctgaccgtggagctggtttaagctccaggtctgatggggcaattgtattgcagctggcagatggattgcagtatatatttgcccatgttgggcagttgacgggcatgtatcgatacaaatacaagctgatgcgacagattcgcatgtgcaaggacctgaagcatctcatctattatcgtttcaacacggtgagaccttgactttactgactttcttttttttgagacagagtcttactcttgtctcttgggctggtgtgcaatggcacgatcttggctcactgcaacctccgcctcctgagttcaagcaattctcctgcctcagcctcccgagtagctgggattacaggtgcccgccaccacgcctggcaattttttttttgttttgttttgaaactgagtctttctctgttgccccagctggagtacaatggcacgatcttggctcaccacagcctccgcctcccgggttgaagtgattctcctgcttcagcctcccaagtagctgggactacaggcgcgcaccaccatgcctggctagtttttgaaattttagtagagatggggtttcactgtattggccaggctggtcttgaactcctgacctcaggtgatccacactcctcggcctcccaaagtactgggattaccagcgtgagtcaccgtgcccagcctcactggacttaactttctcaga

SEQ ID NO: 10397 - DNA, 1173 bp, Homo sapiens
caggaggtggagcttgcagtgagccaaggtcgcaccactgcaatccagcctgggcgacagagcgagactccgtctcaaaaaaaaagaaaaaatttaatccaaaaacattaagcataacaatatcctcaacaagtattgctaatcactcaaaggatcacacagaactatatgattttaataagcatgtggttgtaattgttccattttttaataatccttaactttcctgtagatttttggaaacattttcagtaaacattgaagaatagggaccaagggtcattgtgggattttctttctgttttcagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacctgaaagcaacaatcaggtcaagacacttaattatggcctaggggagagtgagaaaaatggcaacatcgttgagaccccaattcctggat

SEQ ID NO: 10398 - DNA, 1159 bp, Homo sapiens
ctgtaaaatgcgggttcctgggatgtccgtagccctctctggaccctgtttgtgcaagggccactgctctcaagatgtcactttggtgctagggtggcctgtgttctatcccagtgtcacttgggtgctggggtggcctgtgttcaatcccgcagccctaacctgcccacgtgcttctgcagggtgaaatccgagctacagctttcaatgagcaagtggacaagttctttcctcttattgaagtgaacaaggtatggccgtgctgactttagaactgacaccgcctgggggtggagtgcggatgaaaagacgctggcccaggggaggggtgtgtggtggcagactaggggtttctgtccgatttgatggtagtctcaggttctgtggcttggcctccttcgcaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtaggtaagctcgtgtatgagaaggaagagcagggatgactagctttctttgcagtgtacggggtggtgtcaggcttcagtgcttgccgttcatcatttgctggcgtcggaatgggagtcttgaccacctcctgctaacacgtgcatgtgttttagacatcatcgggatctgcaagagctatgaagacgccactaaaatcacagtgaggtctaacaacagagaagttgccaagaggaatatctacttgatggacacatccgggaaggtggtgactgctacactgtggggggaagatgtaagtgctgggatggggtcttcaacacgcacaggacctcctggggttggggcgtggtcttgtcctataggatggggccttcagcacacacaggaggagctcctggagttgggggagggagtggtcttatcctataggatggggccttcagcacacacaggaggagctccaggagttggcggagggggcatcttgtcctataggatggggccttcagcacacacaggaggagctcctggagttgagggagggaggggtcttgtcctatag

SEQ ID NO: 10399 - DNA, 1870 bp, Homo sapiens
gggggggatttttggggccattcagccccatcgtgtctggacagggaaggtgaagtgaagagaggctgcctccccagagctgagacaggacagactcggtcctctccctctgctgcaggtgctcttcctttcaccactcagcttttcttgaaatgaaagtttgaaagtttagctttcagaactagctgtgtggctttgtgcaagtcacatgtcctctctgggctgtatcccctgcagtagggagaataaatgaaactagagaaaccctctaaagtccatctcactaggattctaggcttctgggtgtttgggagcttgggtaaagaatcagaagggcctgtgctggagaaaggacctgttcactcgcccagccccagacattcaggaggaggctgtcactcactggaatgactgaactctgaacccgtgcgtctgttccctcccgctgggctcactgaaaccactgaagcaaaaggggtttcactgctccacaccacactttcactgctcacaaactacttctccctttttgaaggacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggccttt

SEQ ID NO: 10400 - DNA, 1653 bp, Homo sapiens
ctcttctcggtgggcttgcctccctggcctttctcctcaccgtagatccctcttgccttccctgttttaggagccataacaaaagagtctgtgggtgtcacccgcccgtctgccagcctgcaggatcaggtatcggaggccttcaggactctcgtaggctgccttggcatctctgcaccacacttatgcctggcccccattcggcaggcagatccaatccctgggaggataagggtgtgttctggaagctggcagtgccccctggtgaagccctcagaagcctggggcgagagctgtcacctcccccacagagaaagctggaatcgattcctctctcaccactcccttggaaagaacagcaacacaagggaaggcctgttattggtggagggtttgtcctgagagagcagcaggtacataaaaaaatagctggggcaacacgccggcctcggacccagcctgtgcagcccaaaacgggggcacagatccgtcccgccccacccttgctgctgagttgggtctgggcccctcctggtagccggggtatggaggaccctggctgctgcccctgcctcctcgccgggacctgactttccctctgccccccactgggaactggccagagtgtttttactaacaagctagccatgtcacaatctcaacagagagagacgggcgtggggaggaagagagagggagacagagacagagaaaagaaaggaaggaaggaagggagggagggaggagggaagagacagagagaggaaataaagaaagacaggccgggcgcggtggctcacgcctgtaatcccagcactttgggaggccgaggtgggcggatcacgaggtcaggagattgagaccatcctggctaacacggtgaaaccccatctgtactaaaaatacaaaaaattagccaggcgaggtggcgggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaattaaaattaaaaattaaaaaaaagagaaagagagaaagaaaaaagaaaggagggagggagggaaggaaggaagaaagggaaagaaagagaaagaaggaaggaaggaagacagtccttgcagaaataccgctgcagtgtctgccaggacctaagatctcgtactatctattttttaataattgagggtaataaatatgtatttctttctcctcatcatcccccaacctccgatgcttgtcagctccctgcgtctctcctctgatcagaccaagtcttccccaagcaaaaaaaaaaaatcctttaagcaaaaaggattaaaaccttgaaagtaggtctgcctgagctccccccactccctcccctcccctcccccagggctgaagtgaagaggcccctcaggggagccggggacggggggagctgatgctgcaaaccccaagtggggaccttagcaggggagaatcccgcagtcaccccttcccgcagcccatcgagtcctgggggaggcagcctagcccggcccagctctccactggccattgaggaggggctgctcgagaacaaggctgccctagtccccag

SEQ ID NO: 10401 - DNA, 1202 bp, Homo sapiens
gactagaccctccatggctgtggctggaggaggagaggctggtgctcagttgctgtctgtgtggcatgtacttggctggacagcagtggggaattctgggagcagccacaagcactgggtgtctagagtgtttgagtaagcgtctcaggcacactgtctggaaagatgacaggaccctgcattaggcaactgagtctccaaattctttttcctctctggtgaggattaaaaactccccctaatcaatttcaactttgcataaatccacatacacatacctcagattgctgccttgggcacagttttgtttcctagcatttttggggtatgatttcctggcagatgccagcctagacaacatttgctgcaagtacttccctgctcacaaatactgagaatacttttttttactggtccctctttagagctgctcttttcttaccttatttctcacagtgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggtcagccccaggccaaacatccctccccattcgcccctcctcttaattctccagacttttttattcttgggaagttttctgtgcaaatggaacatgattaagtcattgagaagggtgttaagggaaaatatcgaccttttagccgctgacatccagctctgtgtcctgaaaaaaaaaagccctctcgacttcctttggtgtgtgtgtgtgcttgctggcatgttgtatatacgatcatttcctcacttgtttaaatagtgcagcttgtgttggcagtgctctcactcagctccaaatggtttgcatcatgcttaaagcaccctcctttctcccccttcctccccgcccccctccgccacaaagctctgcactaggaaaacagccagggctttttcccttctctgaggaggagagtgataaataggtgactagagagaagcagacaccatgtgttaacttagaaaaaaaaacttgtaggaatatgaagcattccccactgcctggtttctattttccttcctctgaggactgcgttttaacctga

SEQ ID NO: 10402 - DNA, 1162 bp, Homo sapiens
aaatttttttttttttgtttagattcacattacttttttaattgaattaagtttcataccagagagtttagggactgtgaaggtttcaggaaatttgttgagtatttagaaaagccgatggtttcagagagaaactttgatattagcttgaacacagttattgccaggggtgaggaaatagcataccaaagcataataactcatagtgatttatccaaaacttgagttgtttgcatctctggaccctgaaaactcctttatcttgaatttgttcaaaattgcaggataccgggaaggtttgtgaaagtagcaaagaaatgtcctaggcagtagttgtctggtgtgtgtgtgtgtgtgtgtgtgtgtgtgtgtgtgtgtgtgtgtgtgtgtgagacagagtgagagagagactgaaagagagaggtgcctcattgatgggttttctgaatctgcaggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaaggtaaggcatgtttagtttcttcatctagaatatagacagatagagattaatgtagcttctttcttgtgttaccatacctaccatacctacctccccccaccccacccccgaacacacacaccctaccctacgcttcctaccattgtctcagatatttagtttactttgaaatctgtatgactctctagtgcttgggtgggatggaaggagggaatcatgggtatagagcttaatttgcaaatgcagagatgcagttgcacatctggccacgcgaaaggcagcagcaaggcctcttgaaggctgcagacccagagcctctcccaagggagaggcattgctgagatgtttcattgcagagaccatacgcttggcagggattgggaatagctgtttctggactcatgtaccctgtttgttcaatatggaaaagtctagttccctatgggatatccctagtgggagcctgccagggagtaagaaccgagaattgatgagctttggtgactcaaatctggaagcacaaaaaccaccagtcccagaatttagctattataccagtgt

SEQ ID NO: 10403 - DNA, 1230 bp, Homo sapiens
acccggattgggtaagtgtgcaggatgtttattttattttcctacattacaagtcattttggaatttaatattgttagcaactggactgtgtttgtaactgagggcacagggtgtgaattcttagaggcctccaccttctcttctcttcccttcatcttctgtcctactgtgctcatgaaatttggtaaatattactctctatctctcttgtttcttctttctctacctttactaaaacactcctttaaatacaatcttgtcccagcccccaccccagtccctctgggtttctctttcctctgccttccggcttaggtccctagtgagtgcctcagggcagttgtgctaaatccctgggtgcagctgtcagggggtcctccttgggaagaatactgtccactacttttccatcaaaaataagagtaacattttctttctatatccttttgacccatatcctttcctcctatgctcagattcctttgccatattgctgatctcattagataccaagcctcttacggtttcatcatccaccatggatttccatagacatctcagggaaggtagtgtgtgcaaaactaacacttgactgcttaaattcctggaaacagatcgagttttgagtattcctttattccttggatggatccgagttcttcctctctgcataaaactagtgatcctaagcccaacgtaatgcctacacgccagagcagatggatgcctggtgcctctttagtataggatctccctgagtataggagagtgaagaaagtagtaggtggcagtgcccccagaccagtcttccactagaccagttttctactggattctaatattttctgagttggaagttgtattgtgagctaccctttggggtgatttgttttgaattatgaataccccagttattgtcaatgtttccctttcacttcccgtcataacttcgtaagtttatctgtaattctctagaaggcttttttttgagacagagccttgctctcttgcccaggctggagtgcagcggcatgactcgactctctgcaacctctgccctctgagttcaagtgattcttctgcctcagccccccaagtagctgggattacaggcacatgccaccgcgtctggctaatttttgcatttttagcagagatggggtttcaccatattggccaggctggtcttgaactcctgacctcatgtgatccacctgcctcgccctccc

SEQ ID NO: 10404 - DNA, 1197 bp, Homo sapiens
caaagcagatgacactctgctactttgggactgtggtacagtatttttattgtcaaataaataccggtgaggtgaggcttttctctttgtaagctgagtctcaggaaagtctgagctcatgtgtgttttttgtttttgagacagagtttcgctcttgttgcccagactggagtgcagtgatgcgatcttggctcactgcaacctctgcctcccggatttaagtgattctcatgcctcagcctcccgagtagctaggattacagatatgcgccaccacacccagctaattttgtatttttagtagagacagggtttcactatgttggtcaggctggtctcaaactcctgacctcaagtgatccgcctgcctccgcatctctaagtgctgggattacaggcgtgagccaccacaccaggccatgagctaatgtgtttgtatgttatataggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatgtaagttcctgagaatgatgcaatgagccaaactagctcagtaagcctgggtgccctggttcatacagctgtgaggcacagatacttcccactgattgcaaggaagacaaaccacttgaggctccctgatggtcttttcccttctcatgtacgcttcctttatctttattatgtacttccctctctcaccactatgtgtcactgcagaatttagtaaaagtaggattagaatttttttttttttttttttttttttgctgctttttgttcagcgtcatcaacatgatgctttaggattctatgtgggattttgtacttatcttttcctcttggttgaccttatattccgagaatgaactaaagtagcatggataggttagttagtctgatttgtgatgggctttctatgggatatcctcttataactcttgggcggggactttttcctttaagccaggagaaatgacagtagaaaaatcacaggcttgtttagaagatttctcctcttcattgactcagtaagtaattatcgacag

SEQ ID NO: 10405 - DNA, 3720 bp, Homo sapiens
tatgttaaaagaacttagccacccaggaaaaagttagaggcggaagaaaaggctgaggtggattcacaggctctatagatagagaacagtgtagtgctgaaaaggttagagaggtcttttgttctgacaataatgaggtagtttgggatcttggatttctgaatatgacttggatgacacataaggagatgggtttcccccatttcacttacccaagtgtaggtagccccaacacagttaggtccttagccttgtgaattgttgaacaagtgttgtaaacccagaatttctgcttctacagaaatgtccttctttgcctaccagtattagcatttggatatgtaattcttgctcgactttttttgttacttaaccagaatgacagtctttcccctatcttccttctttattcttatcttctacctttccctcccaaactctttccccgacataacagaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggctgagatagaaaagagcccaggtggtgggagagtaggggctgcaaaaggagaaaaaggaaagaggatgggaaaaggggagggggtgagggaaacccacgacgacccagcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcaggtatgatgtggtctattctggctggagggaaatggggatcagccggaggtgtatagattgctatggctgaggaaggtagaaactttttagctgagccactgggtattatttccttttcacgttgtaagggaagggcagttggaaacagaacagaagttttatttctagtcttttttttttttttttttaagacggagtctcgctctgtcgcccaggctggagtgcagtggcacgatcttggctcactacaaactctgcctcctgggttcataccattctcctgcctcagcctcccaagtagctgggactacaggcgcctgccaccacacccggctaattttttgtatttttagagagacggagtttcaccatgttagccaggatgatctcgatctcctgacctcgtgatccgcctgcctcggcctcccaaagtgctgggattacaggcatgagccaccgcgcccggccctatttctagtcttagaaataattatgcatcctactttttctttaagaaaaaattatctttaagggatcatggaatcttgaaatggaaaaagactttctagaatgccaagaaatgaacaacatgtaacttgcagtgaagatcttatttcagttgttaaatttaggtgaagacatatggggaaaaactattttcctagacacaactatctttagaatgacattctgctctgcagaatggaaaccagagtgagtagtatacctacctggtcacattttttatttcctgccaggggaggtggttaatttgcaggaatctcaaaacttgagtctagctttttctgtggtgtatttggagctggaagttgcatgtattttattccagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgaggtaaactgtcatctttttgtcctcaggataaaggcttcagcattctgtagttacgatggatttttactacctgaaatactatgttttagaacagaatatcgacaaaaaaactgcccttttcttgggttctgagccttccctacaccagttgcttccttgggaccataaattactggcaattggagttttgaggttgaaagctttctgaatgccttggcctaaaagagagagaatgagaatgtgtatgtatgtgtttgtgtttgtgtggagagagcgtgtgtgtgtgtgtgtgtgtgtgttcatgtgttcatatctttaaaaccatggaggctttgactgtgaatttgccttgttctcaaattggtggccagtgaatattgtgcgtgcctcccttttcataggatgtctgaacatcagcagaactgtgaaagggttgtctgccccggtttttggtggatagg

SEQ ID NO: 10406 - DNA, 1831 bp, Homo sapiens
atccgtgacaacaacatggacttcactgacatcatcaagtttttcaatggtacgagctggtccagccatccaggctgccctgagcagaggtgtggaggcccccacctctgccccgcacacagctggagggttctcaggaatcctgggggcccttccccaaaggccgggatgtcaagaatctagcagagcagatggaaacagagcagggtagtcagccacctcctagcctgctgccctttctctgggcctctctacagctcttcacgtttccccccagaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacatggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagag

SEQ ID NO: 10407 - DNA, 1223 bp, Homo sapiens
gaggccagtggcccccgggcctgcacagatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgagatggagctgccagcctgcagcatctgggtcattttattgcaaaaggaggctgaggcctgtagggaagcatgtggcaggagcggtgagatcacctgtctcgaccctgtctgcccagcatagtcctcaagcggctctgacccggtgcctccgccgctctgaaaatggcagttctggtcggtctgaaacttttgcaaagcttcgtatttcctcagaccattttacaagcattatcttgtttcatctttcaacagccaagtgaagtaaataagccagacttagccccattttggcagataaggaaacaggattgaggtggcccagtgacttgttgaggccacacggctagctggagacttcgttggagctgc

SEQ ID NO: 10408 - DNA, 3185 bp, Homo sapiens
gacttgcctctgtgggccagctgatagggagaggtttgtgggggctttgggccccaaggctgctgctcagggtgtcctgctgtcccttactctgtgtgccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctggtgagccccagcccccacgctggccccccagccctcagatgttacacctcaaattccagcctccctggccaggctctttcttgcctgctagaaaagatggccctggccccagccccatcacattcccacgcccccacgagcatctacgcctccagccacttgcttccccgcccttctgacctgctccctgccccatgttccccacagagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagccaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttctcccccgccctgccccgccttcgtgtgctgctgctgctattgctgtctggtgaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtccccagtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagccacctccgccagaccccgtggctctgggagagccagctttgctattcccattgtgacagcgatggcaggcctgacccacggggcagttagagcagcctcgtggagc

SEQ ID NO: 10409 - DNA, 1155 bp, Homo sapiens
tttttcctccaaacaggtccagcataaacgagttccctgtggaaaagaggaagtcagccttttcctaacggccatagaaaactcctggattcatttaaggagaaagaaaagagagcgtgtgagacagctgagagaagttccccgagctcctgaggacgtcattcaggccttggaagagaaaaagcccacccccaaagagtctggcaatagccaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtg

SEQ ID NO: 10410 - DNA, 1099 bp, Homo sapiens
ctcaaaaaaaaaaaacaaaaagtaaataatctttgtgctggtatacctctgttaggctgaatttggttgtgcatagaattacacttgatttttgtagtacaaagttactagttttactcagattagtagagcatagcttttttccaatatggctggaaatacttttaagtgtgcatttagttttgaaagattttatttcttatacatattttatcttctagatgttgattttattagctccttaatgatatgtctgttagcttattgttcctactttaattaaccaggattgtacatttattctgtcgacttgcatctctaacttggtaccattctcttcatcccagtacatatttttatatcacttctgggaagtgtcctgatgattgtcattcacagtgtaagttattatttatattgacagctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgaggtactgtatatacaaatgtcttcatggttttattgctgatatctgaagtccttagataactttgctaattccctgtttcagggctgttaatgcatttaaaaatctgcatccagcaattctgaatcttgaaattctctactcttcacagcttgctgatgtgtttacattatttaaccagtgatgattattgctgtcagcctatccttgatttgatacgtgatgggtattctcctaaagaattaaaatttatcagaaaaatcagtgttatgagatcatctcaatgtaaaacaaaacctgagggagaggttaaagttttctgtcagaaaaatagccttcattaatgaagataatgattttatttataaatttatggtaaaatgcagttcagtatttattttttaaaattaattccagatgtgatagtataaatgtttttttaaatgaag

SEQ ID NO: 10411 - DNA, 1121 bp, Homo sapiens
tgcctgtatatccttcacttagttaccatttgttggttttccttcatgtatgtgtgtatattttgctgaaatcatttgagcgttctttgcagacatcgtaacactttacccccaagtattttagcatgaaccacctaagaacaaggatagtatataaataaccaaaataaaattattcacactcaagaaatttaccattgatagactacatattgagatttgttcttgttatttccataatgccctgcgggacttctttttaaccctcatccaggacccagtcagggatcgtacgttatattcactcctcatgtcttatgagttttcagtttcctttaatctagaatcccctagacttttattttcttctggtcttttgatgtttttggtatgtatagttttatcgtattatgaaatagatgctatttaaacattttgccttttactgagtcaaataacttttttgtttttaaggtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttgggtatgtacgcctcgcgaggtctctgaacattagattttggagtgccagacaaactgtgttttacataatcgtgtggactttgccaggtaagaaatgactgtgctttcagggcagaatagagaagacatgaaaatcttgtggattcctaccatttgttttaaattctcctttcccgttaactctttccatcgttagccttataataaaaacattactttctccactgcacaacattggttttggaaaccacaatttgtgaagaggttacttaccactctgatgggtaatttttctcccctattagtttgtttctcaaacaaaatcttcctcaacctttcccactggcaggtgtatactatcagatactagaaactcagaaaattgtatttgatttgagtaaacatcctcactatcatctggacttgaatctggaatttaagagagtgaatacagtcaagtataataaatgcactaaagtataatggaccaa

SEQ ID NO: 10412 - DNA, 4259 bp, Homo sapiens
ggcacacactaccatgcccggctaattttttttttaattttgtattttgtagagagggggtctcactatgtttgttgtccaggcttacgtgtgagttttaaataaaccatttctttttctttcagatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtggataagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctataaaactagatgtgatttttttttttttttttttttttttttttgtcttcctttgcacaggggaaatgctgatagaaagtggggctgtgtgtagctccagtcacaaagagtgacacgaatcggtgtcagggcagtaaggcctcatgagctgctttccttcagggcagcacccgaactggctttgctgtcccccttcccccgggtggaggagggagtgcctcagcctgagccttgccatggcatgcgtctgcggca

SEQ ID NO: 10413 - DNA, 1122 bp, Homo sapiens
ataacgctcctgcgggagatctcgctgaaaacagggatccaggtgggcatggctcacagcatccccgctgtgtccccgctgtgtccccgctgcgtccctgctgcaggctcccactcctggccagggccacaggggaagtggctttttcacggtagccgtctgtgcgcaagcgttggtgggttgggaggtgccaacccgctgaacctgggcctgaggcttcctgtggtgggggggctgccccccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggtgtgtggccaggtggggctgggtggaggtgggggttccccatggcccgtcctgaccttgccacccctgggggtgccctgcaggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggtaccctctgggctgtggcagcaaaggcctggcctcgtgttgggggatggggagtgagggggcccctgacggaggagtgggtggagtccagggagaccccaggaagtcgctggttctgcccaggccacccctggctccacccctctgtaactgtgtcccgagcgggagagctcaggagcaccctgtgctgcggtgaggtcagttctgggaggcgatggcaggggacccccccacagggcgtcagcaaggacgcctcctgagactccgtgagtgggcaggaagcatgccaccgagctcccacgtcctctgtgcccagtgcaggctgtggggttctgggtgccctgcctggccggggctggtggaggctgtggtggggttctgggtgccctgcctggccagggctgtttcagggttagcatgtcttaggatccctactccctgcaaagggactgttttttcttctgtttataaatgggtgggttgtttgtttgtttgtttgt

SEQ ID NO: 10414 - DNA, 1748 bp, Homo sapiens
ccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttaactgacattgtgaaattctccctatagcttttgccattcaagcaacattgtgatctttcttccccgccacgtgtgtgggaatgattgagtcctgtttgcaagctggagaggagctctccctttgctagtactttctctaaagtactagtctagtaaaatttattcttgttagaaggtcaacaaaatatctgtttagcttttatgaagagtcaccgtagcagcccccacggctggaaagaggcctgtacgttctggacgcgttttgttggctgggcttctggaggcactggcaaggtcaaactgcatttctttaagaacagttgcaggatctggctcgcctctgtgggaagccggcattacaggtgcttggtggatgggccgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctg

SEQ ID NO: 10415 - DNA, 1191 bp, Homo sapiens
ccccggcagcccggtgaggcggcggcggaggcgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaatagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgtctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcag

SEQ ID NO: 10416 - DNA, 1250 bp, Homo sapiens
ccagaattcctggctttgttggtgcatctcagtggcggtttactcttcccaagctgtgacggcagtgggctcgccagcatgaatttctactgcaggtggaggaggcgccagggagacaactgagggcgcgcatgaggtgtagacaggggcttattcccatcccagcacagtctctgcttctactgacggggcaaagatgtcttgtggtcagcgtcccagctggcatgcctctgcagggtttagaatatgctccttcacagactttccttttggttttacaccagcagctcaggtccatttgttccacggcctttcagcactcagcagtctcctgctacagatcagcgaagccattctggaaggaggtggtgtgcagtcaaaactgggtctttgatgtaaccaagagaaatacacactcgagtaaccttacagttttcacagacacacagagagaacccagaaaggcagctttaaagatttttacttctcggagttactggccttattagtttctctaaccctcctgcccactctcagtcactcagatcttgcaacatcttgagtgtgtcctgaatgatgaggccttttctttggagtttaagagtaagaatggatagtcaggacaggcccgtggcaggcagctgggcgtgattttaccctggacactccccacacatgtgggcacagggctgcacactttgtgtgttcctcttagtcttatgtgtaggagattttacatacatgtttgctgcttgatgataattgcagatacctcatttgtttcccactctcctctctggagagttaccaggtacccaggataatttgtggcgtcctcaggatgtagtctcctcctctggcccccttgtagtctgatcctgtgaacccctctccgttcttcagccactgccctttccagctgcatttgtacagcagcctcttcactggtctctgccctgtctccattctgcacactgcagcgggatgaacctttgttgttgttaccagcttaatttagatgtaatttgcatacagttcagccatttaaagtgtacacttgagtggcttttagtatatttacagttatgcaccagcaccgtaatcaattttaaaacactttgatcacccaaagaaaccctgagtccattagcaattctccctattccctcttccctcttagcctctggccaccactgatcttccttctctctctgtggatttgcctgttctggatagttcatataaatggg

SEQ ID NO: 10417 - DNA, 1353 bp, Homo sapiens
ctctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcc

SEQ ID NO: 10418 - DNA, 1161 bp, Homo sapiens
tccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacggaggatcctcagcgtctgttttcctggggagtggtcccgccgtctccacctatggggcgtctgcctggggccctaccacctgcccataccacctgcccataccacctgcccacacccagtccaggaaacgctgagcaaaggtctggggttcacacatcaccaggattgctcccttggcccccaagacaaggctctggagagccacactcgagtggcaggtgcagcgcccgcagagcctcccagcttgggatgctcgctcctcacagggacggtgttgacaatttgtgcacgagttcaaggccttttgtgcattttattttatttgtttatttatgtatttatttgagacagagtctcgctctgccaccc

SEQ ID NO: 10419 - DNA, 1145 bp, Homo sapiens
cttcctcagctgacttctcttcctcctggtttcagatctatagctgtgttatgttgagagtcattactatcatactgttgagccttaacttcaactaagtcactcagatgaggctgatagattgagggggagtgaaacacgtgggcttctgaagttttatttaaggctttgccaagttgtgtctcaaaaggacagggaagtaatgacataaaaactgatacatacggtctttgttttagttaaatgaaagcaaataaaaaatatttttttatactgcctggcctgtacagaaatacttcttcactctggtattaagtacaaaatggagagtagtgaatttataggctagttatagcagatgtataagcgaatagatggaatatatgaaagctgatgccattgttcattttatcagtggtggacaaggtggatggagactctgtgcccatggagatactaaaacaagaagtcaggaatacccttctcaatggggctgccatcttctttcctaatcgacagacccgacggaaccatctcttcaccatgatggtaattattactaaaagtctggattcaatgtctgaagtctgtgaggatgaaatttgctaggctttgttacctctgaatatatcgtctgttgcaacgtcccagatgtgtattaatattatatgcagagctttgtgtgggacagatatctaaggacatggcactccactcagagtgggatgacacgtattcccaatctgtgtttcatgatcggatgtctcacaaagtgacagtgtagtctccttcatctttgtgacttgcctacaaccatcctttcttttccacattttacctttgtattataggcaaattcaaaacaaataccaaagctaactaaatagtatagtgaatgcccctgtcccccaaatgtacctgtcacctagcttcaacagtcataaattcacgctaatcttgttttacctacagtgtacctcacccccctttcctcctttccccactgaccattattatttcaaggtaacttcctgacatttgattcataaatatttcagtatatatctgtaaaactaataccaccaagtttttttgtttgtttgtttttagataggttcttgttctgttgcccaggctggagtgca

SEQ ID NO: 10420 - DNA, 3504 bp, Homo sapiens
tgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaatgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatgattcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcaccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtgcatttaaagtggaaactttaataagacatttgtagttacttctaatgcagaagtaccaataagcattaaaaacaaattttagaaaactcctgacgtgaataagtttcttgaccagctgccctccagaaagtttgaattccaacatttttcaggaacatgctgttgacagcagtaaaagtagctattttatgtatgtatttttaatttttaaaagtttcagtaggtttttggggttcaggtggtgtttggttacgtgaggttctttagcggtgatttc

SEQ ID NO: 10421 - DNA, 2047 bp, Homo sapiens
tattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggttttttttttccttttccaaagactgtaaaaatagttgccccaaaatgtcagcactgcacaccctccagggacttggaatacaatcctttttacttttttttttttttttttaagaaactgggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacgtgtcatactaaggtaacatgtttgtgaggttattccactagtactgtgatcacgtgggtgtcagtatcttt

SEQ ID NO: 10422 - DNA, 1219 bp, Homo sapiens
cctttccttcctttcaagggctgggtggggcctcgcatagatcagggccaggactggccaggaactcctcactctgtccggacttctgttctcccaaatcctcctggatgtaccagggcctgactccttggcccttccctctgggagttatagcttcccagcagcacgagacccagggtcacagctgcaggtccaggagaaggcttgcgtctccaaacagcaagaaaagggaaggagggagggcagccttggcacaggccccactaagccccactgctgacctgacacccctttccccaggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggcccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcag

SEQ ID NO: 10423 - DNA, 1321 bp, Homo sapiens
ggacttgggttggctctgcttggcggagcagggtggaccgagaatgttctgaccagctctcgtcctcaccacccacaggcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggtgagcagggcctggcccaggagcagccccaggcatttcacagccagggagtggaggccgggacttccccagggcccaaccctcagccttctgatgaaggtaggccaggctctgctcccatcccagggacccctctcctggcctcacccagctcgctctcccctggcctaggctgccagctgcttggacttgaacctggtgacccgggtgtactcgacagcactgagctccttcctgaccaagcgcaacagccccctcacagttcccatgttcctcagcctcttctcccggcacccggtgagtgttggggcctgccctgcttcctcatggtccctgctcagcccagcctgcacctcacagcccttgtcactccccaccaggtgctctgtcagagcctgctccccatcctggtccagcatatcacgggcccggtgcggccccgtcatcaggtgagagacttcccagctcccagcccagggcctgtctgaattaacccgcttaaccctcttctgactggatattgtgaggccccagagcgctgtcctggtgagcacgggcacagctgtccctgccccactggcttggctgtgggtacatggtctctgaagggggtggccgtgccctggcccctgccacacagtgaacacacaggagctgagggggcagggccagcctcactcccgcagccactgctgcccatctggccacacacaggatgcccctggtagtgtctgctctggtgccagggctgttgggggcaggctggaggaagatggcactaagccaataatgggcaggaattgtcccaacctgaggtcccacctctatccagctgggaggccttggtgtccccacctgcacacaaaggcacaggagcaggtagtcacagagcccagagcagcaggcagcctcacacgctgcccacagcagtgcccagcgggcccccgagccctcatgcatccctgagccgtgagcacccaacgtgccaag

SEQ ID NO: 10424 - DNA, 1859 bp, Homo sapiens
agtctgggagagaagccccgccggagccgcaccaagaccatcggtgggtccttggtcacgagagggactagagtggtggggtggggccagcggtcccctatccgggctcaacccctccctcttgcagacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgagttgggacctttgggagtggaatgtgggctggggctcactgagcagcgagctgcaccaggggtgccgcttcagcctccagcctccctgccgggagcctgcggccggtgggaggggtctcaacgaggccttggcctggcctggccgcctctcctaggctccgttttcttctgggaaatggaggtctttggtcaaggctgagtggggcctggagaggagggcgggggctgcaaatgggtcagtggctggcacccctccccaggtgctgaaccccgagaccagtgaggatgagaatgaccgtgtggtggtgacggacgattctgatgagcggcggctgaagggtgcagaggtgttgccagcatgggccgggcgggggcggtggggagtgggacgatcggggaggtgtgtgacgcgcctgcctctaccacacaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctggtgagtgggggaggtggaggggggggcggccggggagggctcgggtgtccccatgttgtgtgcctgcccgaggcctggctgaccgctgggcctctgtccctcagggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgagcctgggggcgggccgcacccacccccgcctccctgtgcgcccacccccgcctccctgtgcgcccacccccgtgttgctgacctgccctcctggctgcaggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgtgagcacgggggtgcagggcgggcaggtgtggccggcagcccccaggcgcaggagagccagagctctaggcttgctgtctgcacaggaaggagagagccaagcttccagcctgggcccctagctcgcaggctcactgctcagccctagaggcacacgtcacttagtgattcccacagtccttgcttcatccccgcgttctcccgacacagtgccaacagtgccctggagctggggtccatccctgcccttgacagtctcaagtggggctgtgccaacagtgccctggagctggggtccatccctgcccttgacagtctcaagtggggctgtgctggggtggagggggacagtgggtgcacctgtggcaggggacacccaacccagtcctcggaggtgtagtgtgcatgggagtttgtcaggctgggaggccttgggcagggcagaaagggaggaagag

SEQ ID NO: 10425 - DNA, 1265 bp, Homo sapiens
aaaaaaaaaaataaggggtggggggcaggtacctccaggggccagttagcgtcagtgggatgcttgtcaaaaaccccgctgcctgggaatttgagttttgttagcaactggcctctgatgactctgatacctcaccaggtggccccgtgtcaggagcaggtagaacaggatccaccaggctcaccccgcagaggaagtcacgatttcttctccctccatccttaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggtgtgatggaggtgggcggatttgccctccctggggccaagggactgcatctggccaggcccagatttgtcgtttggcctgggggtgtcccggctgctcttgtcaccctggcccttgcctgtgaggcaagtgttccctgagtcccttgccctccgcaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccaggtgcgggcgacgcgtgtcctctctcggcccccttccctgtccgtgaagtgggctaggccactagtcctgaggttcccaccaggggcaccaagggctctgaccaggctctgtcctgcaccccctttagctacctgtgtttccgcctgctgggcgcggccctgcccctgctgaccaaggagcagctgcacctggtgatgcagggagacgtgatccgccattacggggagcacgtgtgcactgctaaggtgggtaatgcccgtgcagctcgacactgccagaaaggctagacgtggagctctccctgccaaaaaggggagcagggcacctcgggggcttggctagagctatgggtgtcccctccgtctgggtagtgagctgcctgaacccctttccctcggacaaattttttttttttgagatgaagttttgctcttgtcgcccaggctggagcgcagtggtgagatcttggctcactgcaacctccgcctcccaggttcaagcgattctcctgcctcagcctcctgagtagctgggatta

SEQ ID NO: 10426 - DNA, 1099 bp, Homo sapiens
agaaggtacatagaaggtgggactagggacctgaggcttcttgggagaagttgaagggggaagggaggttaaggtttgtgaagacgtagttgggccactctcctgaaccctcttcctcctgccacacaactcctggcagctgttacagtcttttgaagacctccccttgtgcagcatcctgcagcagatacaagaaaaatatgacctgcatcaggtgaagaaggtgagagtggggccagggaggtcagcagccccaggggtgggaggcttggggaatggggagttccagggcccctcatgcctgtgcctggaatccttttctaggcaatgctgagacctgctctctttgcaaacctgtttggagtgctcgccctctttcagtcaggtcggctggtgaaggtaagagctttggagggactgggggaatgtaggctggcttgggatgggtgggggacagtcgtgtgccctgctcataccctctgtccctctgtggggaccaggaccaggaggcactgatgaagtcggtgaagctgctgcaggccctggcccagtaccaaaaccacttgcaggagcagccccggaaggccctggtggacatcctctccgaggtatgagctccccagctgtgcgggcccaggcaacactttgttacagagacatcaagggggctcggatgagaatctggaacagcactgttccatagaaatacaaagatgtataatttgaagcgtttcagtgactttgttgaaaaggtaaaaagaaacaggtgtcatttagtaacatttagtgacatttgactttatctggtatatctaaaatattatttcagtgtgcattggtataaaaaagtgttgagatatcttacactctttttgtcaggtgtctccaaaatccagtgtgtatgttacacttaggcacacccctgttcagattagccacctttcaggcgctcagcagccctgtgtggctgtggctaccgtattgggcagtgcagctctggaactgtgcctggcacgtggcaagtatataaaacgtttgccattgttatcctggtcaaggctggccccttgtgggcctccactgccctacttgggaaggt

SEQ ID NO: 10427 - DNA, 1472 bp, Homo sapiens
ccggggaggacagttgctataagtggtgtttagaaggtgttgctataaggatagcaccggaaaaagggctggatgtttggtagatgccgagtggcacttgcctagcctgctcccgtttctcaaacagggaaacagacccagaggggaactgatgtggcccaggtcacatgggtgggtggcagcacagcctggatcccaggctccccactggctcttggccttggctgtcttgtctgcccccacctgccccacccactactactgcccagctgggatggatgagtcgcacggagctgatcaggcgcttgcactctgcatagccgggtaaatcttgtgtccccgcctcccatgcaaagatctcatcgtgatcagggctccgtagctcatcgttggcccagaaggacctggtgccactggttcctgctgcccctgcacgggtagccatgccgacctggcccagctgagaggggcagggggcgaggcactcctgaccccatcatctggtccagcctgggggaaaaggtgagggggcctaatgtcattggaaccctccatcttgacttctgtcctcagctttttgggactctgggaggagcccagtggaggtgtttgcctcccaggatcgcaggggctcagcagttggagtggggccatcccagcttttgctgtgtgacttggcccgtcactttcttcctgggggctgttttctctcaacatgattggtgttttgccagaacgggaggggatttgggggtgggcagcttttgggggtgggcagctggccctagctgatggggtctcggtgacatttgtgtctctgtagagtttggatcacgatgaggccagtgagtcggagatgagaaagacctcaaactcctgcatcatggaaaatgggcaccagccgggggcaggtagggctgacggcagaggaggggtggctgggtaggtttgggggttaagtaaggccttggtcaggtatctgtgccaggctggcccttggcctggcatcggggggactctatcctgaaccccagcagggagagaggctgccaggagagcagcgtcattcagtagaacttgtgaaacacagagggaagttgggagatctcaggaggtagtgagctctcctgtttctagaggaaagcaaatagaggctgaggagccgactagtatttattaagctggccatgaggggaagttgggaaaaatcaattctggttggagcagtaagatatccctggtaggggaggtcagagaggctggagcagtcagggaggccttcctagaggaggtgggaggagggcccagggaggctagagccctcctgggaggtcccaggcccctgtggctgccacagctgaccacccacccatgctggtcacatgttccaggtccaggcgatggaccccctgagattgcccaaaacttctcagcaccagatccccccaggcctcgtcctgtgagcctctcct

SEQ ID NO: 10428 - DNA, 1210 bp, Homo sapiens
atcaaaggaggctgtgtcgctggtacatgggctgtgccgtggacgtgggcacagctgagcccacgtgtgccaccagcatctcccctgggtgagcagagcaggtgggagcaccctccttggtggtgccaggacagcctcccctgccccagacccgcactgggagatggcagctggaggggcccccgcagcaggcctgccgtctctccgcagggggaaaggcgaggcccgggccaggctgaagcggtcgcagagcttcggcgtggccagcgccagcagcatcaagcagatcctgctcgagtggtgccgcagcaagacgctgggctaccaggtgagccccggctcccctccggctgctgggacgccccagctaaaagcttgaccaagcgtcgcccctgtccttgttctcccgcctgggcaggagcccgctgaggctggggttaaggggtaggaaccacggtaattatgccttccgagtgggtgcccagctgccctcccgcactgaccccactcaccctgttgcagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagtgagtatggtggctcctgctggctaccagccccagcccagtccctgagcccaacttcttccccaggtggggcatgggggcgagtgggatgtcgggccgctgtctgcaaagctgaaggaccctggggccatgtggtctgtgtacctcttgtgcagatgggaagactgaggcctggagagggattttcccagagtcacacagcactcagtggtggagggggactccgttcctggggacctgccctttttgctaggtgcccagcttctgaggtgcactctgggagaccagccacagaccaggcatgaagggcagcaggacagggtcccccaaagctctgaatctgtcctctctggactgatggagagatgccgttgcttgcatgagccacagctgccagttagcaaggaactggatatgacctgggccacttaaaaggagatttttgcttccaataagattttccttcccgaaatggtgttctggcatttattgtgaaattgcctagcttcttaggtcccacctctagggtgaagatt

SEQ ID NO: 10429 - DNA, 1976 bp, Homo sapiens
gccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggccccacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttgaattttgcttggggtttgtcatttctgtttaggagatgggagttctgtgaataagagactttgcacaccttccaagtgaatatccactacattccacccctgttcctgcacttaaatcactggcctggaaagctgaagatggcatttgctgtcatctctgatcatctctgagtgtgcctgtctcccatctccatgttgtggaaggagcgtcaacagaaagttccccttgagatccgtcctctggatgtagaccgcagtgtttgtgataaacagtggcccaagacagcagggtttggggtggtcccgcacttggaggaagcccatcaaggaacgttggtttattttcacagctgtttggtggtaggactttcatagaaaaatcttgagattctatagagctccagccattagcttattctcagccaagaatcattgtataattgggttggattttagccatgcacttctaaaccttccctttaaggagcggatctgtgtcttcacctcatgcagccggctctcaacaccagtgcctgtgtgcctttgtggggtcccacgtgtcccttgggtggtatattggggggtgggcaggagatccctgggggtgtcaggaggaacatggcagagcctgcaggtgggtgagcagtattctccatggattggttggtccaggctgcagtcttgccctctctctcggattctcccactctggaaaccattcccttgctagctctctcgtctcttgtacgcttggggaggtgagacctattattaacaggacacataactgaaggttagggtttcaaacctgaagccaatctgggaacacaagggctctgtaaaaagcatggctatatgttactgagtcctcgcacacgttaaatggagctctcccgagttgcagacatggccgtacgctctgcgcatgaaacagagcagatcctgccagaatgcagaacaatttcttttaaactttaggaatggtgtccctcatgtctcacattcagaatgagacagactcgagtttttaaagttggttccatgatgttcttgtctgtggtctttgttgggggtggggggtgagagatcataagacagtttgtgagtttcaaacatgattttacctctaagacaaagcatgagaagaaaatccaggaaggtctcacaat

SEQ ID NO: 10430 - DNA, 1154 bp, Homo sapiens
ttttaaagcttggattgggtttgcttttagagcttttgatctcttatctcttggttcttggacttgctttgataccaaacagccctcatagtcttttgaaagaacaccttaaaaattcctaggctgggcgcggtggctcatgcctgtagtcctagcactttgggaggccgagacaggacaaatatttgagctctggagtttgagaccagcctgggcaacagagtgagactctgtctctacagaaagttttaaaattagccaggtgtagtgacacatgcttgtagtccccattacttggaaggccaaggcgggaggatggcttgagcctgggaggtcaaggcatcagtgagcgatggttgtgccactgcctggagatagagtgagaccctgtctcaaaaaagaaagaaagaaagaaagaaaaatccctaagacctgacctgcctactccctagaaagcaccaaataaggaaaagcactccggaagaatgaagctaagaaggctgtgctctctgaggcatccgggcagccttcactggagggacaaggtccaggtaggtgggatgacaagctgggaaggggccctgaaccagaggcaggtgatgtgggtggtggcaccagagagacaccagacagtgttaccgtaggtcttgactgtccaccttcattcctgaagttgatccagctttcttactgtcacgtaggtggatataaaatcgatctttagggttctgattttttgtttgtttttgttttttttgagacggagtctcactctgtcacccaggctggagtgcagtggcacaatcttggctcactgcaacctccacctcccaggttcaagcgattctcgtgcctcagcctcctgtgtagctggatgtacaggcgcccgccaccatgccaggctaatttttgtatttttagtacagacggggtttcaccatgttggtcaggctggtctcgaactcctgacctcaagtgatccgcctgccttggcctcccaaagtgctgggattacaggcatgagccactgcgcccggccggggatctgagttttaatcactcccagtgcaagcgtccttatctggtttgcagactgagtggcatttgtgctgccgaggctcttcctggcttgccctcctctctggctgttgctt

SEQ ID NO: 10431 - DNA, 1881 bp, Homo sapiens
gattgttcccaaatatataaatgcaaaattataaaatttataattttttacttacattgtctcaattaaataccgtcagtggccctatacagtagaggtacttttatgatccccattttctagttgagaagttaaatgacttggccaagataggcagtggcagagttgatgcccattttgggctgtatgcttcagaagcccttgccgtcagtctgttgggagcctaccctttacacaccattcttcttccccaggcctcagccggaccatcctcatgtgtgggcctctcatcaaggaggagactcacagggttagtggagcctcgtctccgtggagataggggaaggggcccctgctctgtacacattggggggtgtggcccagaggtgggtccattccgacctgggagtaggctctggagaagggttgggtggtcttggggatgtttccaggtgtgctctgtccttttcagagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtaactgtgatgggccaagcccctctttggttcctggagtctcttgtttccaagagactcccagtatttctggtgctcacacttgccctttcttctttcctcaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaacc

SEQ ID NO: 10432 - DNA, 1116 bp, Homo sapiens
gggacctgagtctccccaaacagtgtcatcctggagtcgtcccagagagcttcctacttttgtccaaataacatcacttcctatgtgtcgtgacacaggagcacagtgtcagagtgtagcaaatgcttccttgggggagggtgaatttggggatcagctgagtcattgctgagaggcccagccatccttcttaccttccatccagggtctattttagaggataggggtttgattttgttgggagagctgagatcaggggttgggtttcttacctatgtgtacatatgtaaatggtcattccctgtttctgtctctctctggctctcactttcttcctccactctttatctctgccccttttttctccagagcttgcatggagatggtcccctgcggctgctgctgctgccctctatccaccttgaggccttggacctgctgtctgcactcatcctcgcgtgagtgggattgggctggctgtggtgaagggatagggcgtgccagaaacgagggtcaccattccttctctgccccaggtgtggaagccggctcttgcgctttgggatcctgatcggccgcctgcttccccaggtcctcaattcctggagcatcggtagagattccctctctccaggccaggagaggccttacaggtgaccatccaggaaggcaggaagggaataaagaggagaggggggtgagggggtgcaggtgggctggggcttctggcatgttgaccccccattcataactgccatctttgctcatgacacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaaggtgaggaggcctcagctccgccttaggactcatcctgtgccctttgaccaagtgtgcctgctcaggaaacactgtctgctgtggctgtcttgccttgttgtttgcctgtggatgtgatttatgttttctctgcctccagctgcgtagcccgcgggggagccctgatgggagtttgcagactgggaagcctagc

SEQ ID NO: 10433 - DNA, 1204 bp, Homo sapiens
ctcccaagcaggaagccgaggaccagagctggcgttgaggagtcttttaccatgaaagcatgtccgtgcccggtgttgatgccccatagagggctttgcttcttgtgtctacaggaaaaagagacctgggcttagagtctgctgctgggaacggatgggatgtacatctctggctctcagagctggctcactggcctcttccttttttcctccacatccagggcaagctggcctcattttttctgtctagggtggatgccttgagccctcagctccaacaggtaaagggcagggagggagagggagagcccggggatctgagcctggattgtctcttgctgctcctcctctagcttttctgtcctgccttcatatgcccatctgtgtccttcggcctcattgtcccatctcaggtttccctcagagctctctctgatctccatctcttttgggtgtcagtggggctgggggttctgtggctgggctggattcccatctgaccaggtttctgtcctttctcccgcagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactggtagggaccagggctgctagttagtggaacaatagtgaggaagcgtggcaggaaggaacaggaggggagcccagagacatggggcagttggtttttggggaaaatgggttagaatacaggcaggtcgtccaccagaaatgacagaggaggggatggaagaaagacagtgtacagggtagttgtgcttctgccagctcctgtgcagaatgaaggccctggggtggagatgctgctgtcctcagaagatggtgatgcccatgtccttctccagcttcggcagaggttttcgggactggcccgctgcctagggctcatgctcaggtgtgtgtgggtattggagggagcggaggcgtggagcaggagggattgatgagggagtgtcgccttcatcaggagaaaggagatgaaggtgggtgtgggagttatgccagggagcctgctctgaaggtctccctgctctgattctctttagctctgagtttggagctcccgtgtccgtccctgtgcaggaaatcctggatttcatc

SEQ ID NO: 10434 - DNA, 1136 bp, Homo sapiens
cccaccccaagccctcagagggagggcctgaagcagggccagtggaggaaaactggcccttccagcacccacccccacaccccctcttcccgtccccccagccgctccggagacagatgtccctgtggacaccaacctcattgaatttgataccaagtaagaaactcattcccctacttgaccctcttgggacaaagattcctataacattcaaatctgccctcatacctcttccttgcttttggtggggagaagcggattgtagcatcaaatcaagatgccttagccttgtgaggctgcctcttgctgccttttctttgtcccttcctgtaaatacctctggtcccactgctgttcgaacgcctctgtcccagaggcctagcttcggggagggcagggagtgggaggctgggacaagagtcagaagccctcacctcacaaccctctttcccaccaccaagctatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatgagtgtgtgttttctctgtagtgtttagagagtgtatggtgtgcttatccatgattctgttagcttgtgggggaggacccagtctctcttctgcacccaaaagccacctgacacggaggcta

SEQ ID NO: 10435 - DNA, 1203 bp, Homo sapiens
taatgctagaactacagaactttgtcactggaaacttggcctgacctccaggccacgaggtcccaaatccttatatcctgagaagagggacaggattgagaaggttctgaaatcgtcgcagggaccactaccattactaatttttacggtgtgccagatactctgcattactttatctaatcctcaacaactctaggaagtagttattgtcacccccattttacagacaagattaacataagttaaatgatttatttacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgctttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaagatcagactctcactggggtaggcaagggactgaggaggtgaaaccaacccgtatggtgtcccagcacggcacctgctaaggagggagggtgggaaagcccaggccttcgctgcgggtacaggaggatgcaggagagggctgaggtgggggaggaacaactggtgtactgggagagagatttgggacgagggggaaccatcagcaaaaaatgaagccaggaatcacagtaagggcgcaagggctgaggccagttgtttccataaagaa

SEQ ID NO: 10436 - DNA, 2186 bp, Homo sapiens
caccttcaaaagttttccaactttcccggaaagcccccaggggtctgcttcctcatctcagagcagagatacctggagctaaactctaggttacttggagacccaggcgtccgggccctaacagctcctgcagaacctttgaccaaataagggcaaagttgcttctcttgcctcgcccgcccccctcccttcccctctccgcttctgcttttcctgaaggagagttctgagcatccaaaggctcctcacttacctcactgactccctttatttcctgggtttactttccccattaacactgacatctaaatctctagaggagtatgtcatcccttcctccctggttccatattctaagtttcagaatcatgatctttttctgcactaacgtcccacagtcctcagagtttctcacagttcattgatgtgtactgagtatataatttatacttagcccccacggcggggtggttctcagaagtggaagacaggtgggtctttggagaacacggtgggaatcttggtgcactgactaacttgatgggcgcttggttcctcttccagccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagagtgagttcctgagtcttacccttcctttagctccaagatctctaatgtaccgccttctggtaatcttgagggtgcttttttgtgtgattccccaacatgaagggagtcagaccagtattgtgttccttgtctgctggatgctggaacacgggatagtccctccattctgtctcagttcctcatcttgtaattcgaagttgctgaactgcattacctcttaaattacttactgccttgagctcggattagaaactgttttctaggagtataggtagattgttggggtcttgaatcatcgagttcatcgtttgagttcttttgttagaacctggaggtggcatgcacatccacagccctttctagcctgaacacatgaatcaacagtctatgagcctttgacccctaagtttttagtctgttcctctccagcgtttaagcttgattttcctcttttgaaaagccttattgtttcagggtgactgacagcctgcctgtgtgtggtgggggggcgggttgggagagatgaggttgggttacagcccccagggctggacagctgctgaacagctggcagggggtggaattgtgacacctggatcctagcctcctttctctttcctcctcctccagcgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctactaacaaggtgctgtgtgatttgagcttgggtgtcagaatgggggataggcactgtgacttgcctcctttatcgtggcttgggagcagggaggttgaggtactacaaggtgcaggaatttgagcttctggccaggtggccctgcccctccacagtggcatttccaggcctaagtcctcagtgtgctggtcaaattggtggatgatggaatagagccatctggaccagagaatgggtgcaggcctgcaggcaaggcagggctagttgagtcatccttgtgggtggggctcccccttctgagtcatagcaaatgccggctggggctgtccccatgactataggttagtgtctctcagcattcccttgctccttatggctaaaggggtgattccaccaaagggttaagttcacctgtgtgagaatgatcttacccttccttagtccacaaagaaacaatttta

SEQ ID NO: 10437 - DNA, 1105 bp, Homo sapiens
gctaattcctcctgctttctccttccttccttcttctggctcactccctgccccgataccaaagtctggtttatattcagtgcaaattggagcaaaccctacccttcacctctctcccgccaccccccatccttctgcattgctttccatcgaactctgcaaattttgcaatagggggagggatttttaaaattgcatttgcaaagttcggtgtctgggctggcgagtgggggagggagggaatggggagtaggccccgcccctaccgtcctttgcaaataaaaatctagcggggcggggggggggaggagcaggaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcaggacgcggccatcgtgggctacaaggactcgccctccgtctgggccgccgtccccgggaaaacgttcgtcaacatcacggtactgcgaggcctgcgcggtccggggcactgctccggtttggaccctgagggagggacttgggtgggggcgggcgcggtctagggcgcgcagcgagaggccctgactgggtgcttgccctggaagcggcgcgaatggcggctgcacgtgagtgggtccctcagttgcccgtaggtcctatgccccaggcggcggcgcccatcccgcccgctaccccgctttccgcgacggggcgttacatccggggcacagggcggggaggggcgcggcgcccggtgcggcggcccacttccgcctctcccagggcggggcggggacgcgcctcagtttttactggggattgggattgagaggggacccggggatccttggacccccagctccccgtccggctgccagcccgcgtccctctaccattgtttctcctggtgcggaagggagccccaggcgcgtggtcttggtcccttgcccaccctctgtgggcttctggcccctcct

SEQ ID NO: 10438 - DNA, 1205 bp, Homo sapiens
gagggggaataaagggtaggggtagagaacagacatttctgatgcctcccagtggctacaatcagtattacacctctggtttatagggacgtcccaggaaatacttttaagggcctcaaggtagagaaggtgcggaatgatgtgtcttatctcctctccctcctactcctctccactccaggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagaggtgagactcaggcttacctcctccctcctccctcctatttgtcttctgactccccaaaacaaattgtattaactcttaccccgtgg

SEQ ID NO: 10439 - DNA, 1137 bp, Homo sapiens
ataaggccccagccccactgctcatctatgactcagggtggctgggattcaaaaggggtggggaataggtgggggcgagggtgggggaagggttgaagaggaactggtggaaagattgggattcctgcaaagggactgaacagaggaagagttggggagcagactagccctccccccaccccagcctgtctcctggcagtgtctctatggctgctacgttcactcttccatcgtccccacattccatcggcgctgctactggctgctccaggtaaggacggaagagcccagggagccaccctcttcctgactctttgagggacacgggtctgaaagaaggaagtgaaaggatggctgagttctgagtgaggaaaggagcctgggaagaagagaaaggggcttggggatggagagagtcagaaattgggggcgaggttaggagggtgcccaggaagaaagtgaggattaggaagccaagcccctggacctcaggaccccatggctctgtgtgtccccttatactctcagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtgtaaggcagcagggtggggatagagctccaaggggagagtagaaacagggctcccagaggggccatggttctggacccaaagcctgagggctgatcatctccctccaagctgggagggtgctaggattcccggtgtgttctcaggtattagaatacggagaaaggactaaagcaacatatctgagcagtcttgaggctgctggcctctgttcacctggccagaagtcttgaagcatgtcaggtgcttggaggagccatcaaggtactctggggcctgtttcgtggggatcccacagcacttccccctaacttctctagttcatggcatcaagtggagctgcgggaatggaacagaagagttctctgtagaacacctggtgcagcagattttggacacccacccaaccaagcctgctccccgaacccacgcctgtctctgcagtggggggcttggt

SEQ ID NO: 10440 - DNA, 1160 bp, Homo sapiens
tggtggtcactctggagccttgtgaaggagctgagacatatgtgaatgggaagcttgtgacggagccgctggtgctgaagtcaggtagaagatgtgtcgcagattgagggttctggggcgtggctgtgtgtaggaagtctcaagggaggtccttctgggtgcatcctagaggaggaccctgaaatacatcagaaatagcacggggatataaagaaggaactgggaagtgaaggtcaaggagtcaggtcttggtttctctttccgccccagggaacaggaagaggatgccaagctcttgcaattccctttggttgacaagaatggggttggtccctgggtgtcagccaggggagcataggctccaactgccttcagacttggggtgatgaaggggagggtgtcacagcccctgtgccagattctctatgccttgggtgtagggatggatttggtgctgatgggaagcgagtttacttttccctcctcccatctctagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggtgcgagggggttacccacgtgccccatggccgtctaggccgtccctcccgggcctctgggcccgtgtcctcctcttgtcagatactcaccaaggttgctcttccttccctccctgtccaatcccaggctgcaggatctggagaatcagtaccggaaagaaaaggaagaagccgatcttctgctggagcagcagcgactggtgaggggcagcaggggctggggatgggctgatgggcagatgagccgcaagcctgagtccgagtgcagtgctcaccgctgagccagagtgggaaatgggcatgggggtaaggggaagggtccaagaggaaaaagccaggagagagatgtgactacaggaagaatccattgtgaggaaggaaggaagattcctccagttgaccaggccttcccatactccagtttctcgtgccaagtttatgattttcaccatatccaagtaccacctgtgttggtat

SEQ ID NO: 10441 - DNA, 1182 bp, Homo sapiens
aaccctgtctctactaaaaataataataaaaaaaaaattagctgggtatggtggcaggcgcctgtagtcccagttactcgggaggctgaggcaggagaatggtgtgaacctgggaggtggagcttgcagtgagcggagatcgtggcactgcactccagcctgggtgacagagcgagactccgtctcaaaaaaaaaaatttatttattatgtgtatttccttttatatatgggatattttcttaattgattaagaagtcaaatttgttttagtgaatcaattttcccatttactcccgaattctaaatggaatatttgggaaaactcagttataccttgacattcaaagtaatgcactatttgaaagttagacattagttcagttttgcgaatattaatatagtgtctggtcaagttacttgttataataatttttagcaaatggaagggttagagtttcttagaaaagcagtaaatgaataagtcgtagcatttaattctttttaaccataggcccaagaggatgctgagaaacttcggtccgttgtgatgccaatggaaaaggaaattgcagctttgaaggataaactgacagaggctgaagacaaaattaaagagctggaggcctcaaaggttatgaaacattgtaatccatttgcttgaaacccaagtttctgccccaatgccatgaacaaaattagaatcagtaatagggaaaaaaacctgtaatttagactatgcatcttaagaatctttctttaaaatgcaaaaaactgccgggcgaggtggctcacgcctgtaatcccagcactttgggaggctgaggcgggcggatcacctgaggttgggagttggagaccagtctgaccaacatggagaaaccccatctctactaaaaatacaaattaaccaggcatggtggcgcatgcctgtaatcccggctgctcccagcctcgggaggctgaggcaggagaatcgcttgaagcccggtggcggaggttgcagtgagctgagattgtgcctttgcactccggcctgggcaacaggagcgaaattctgtctcaataataaaaaataaatttaaatgcaaaaaactgctttgagatggttttgctcttatggacatttaaaataatcacaataatgatgttttatcacaagtggctgctttgtcacaaagtta

SEQ ID NO: 10442 - DNA, 1246 bp, Homo sapiens
tgggagctcactaggactctgctttttttttttttgtttttgtttttgtttgttttttttgagagggggtctcgctctattgccaggctggagtgcaggggggatctcagctcactgcaacttccgaccccctggttcaagtgattcttctccctcagcctgccgagtagctgggattacagggacacgccaccacccccagctattttttgtatttttagtagagatggggtttcaccatgttgcctaggatggtctcaaactcctgacttcatgatccacctgcctcagcctcccaaagtgttgggattacaggtgtgagccaccgcgctcggccaggactctgtttttgtatatctgcacaggtctgcccaactcttaaagggacactacctaatctcttccaccctgccccttccgcctaaggcctaaaagtgattttaagtacatggcaagtactttatgatatggagatctcagggagataaaaggttgattgttgcctccagtagaataaaggcttaatggaatgttatattaatcagaatttgtgtccttcagtgcatattactcatttcttgtcataaatttgttgaattaaggttaataagttcccagaaattaagctttggtagatttggtatgctgagattgataaatcttcagtactttttcaagtgcagtgtttaataatgggcaccttgatagcagttaggaaataatgtagaaattcatgagagtgggcttgtcaaagtctacgtaagaaagatacttttccctcatatttccaaattgttctttggttgttatgaagattgttcccttagccttcaaaataacttcaagccaattagaatgatggtttaatattttcaaatgtcattgctattgagttccttcatacactgtgtgctttacgcatagatgtttcaaaggtaaatttctaaatgtatttgcaaaactaatgtagttggcccctgatagtgtggtgtaggaatggttttcataaacatttcagtagactgttttaaagcctggctaaaaattagtcagaaaaagaagtgggaaaagggtgttcatggagagaaaaaatatacaaagaacagagttaggaaagaaaatgatgtattgtaggaagtatgagtagttatgtggctgggcacagggggtgactgttacgaaataatgggaatgtaagctacaagggaaagccatgaagacatcacttagggaggggtgatgattg

SEQ ID NO: 10443 - DNA, 1209 bp, Homo sapiens
aagcaagcaagccaggtgtgatggcaggcacctgtaatctcagctactcgggaggctgagacaggagaatcacttgaacccgggaggtggagactacagtgagccgagatcacaccattgcactctggcctgggctggcctggatgatgagcaaaactctcccccccaaaaaaaaatcccagtccgttacacggtagctttggggaattatttttaaaatttttaattgttcttgctgtctccctttgaagtgactagtactctggtgagttaatctgctacatctcagctaaaccagtcaaagttcagaaaatctaggcaggagccacctgtagttatctcaccattgtttctccaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatatagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggccattggctactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttct

SEQ ID NO: 10444 - DNA, 1778 bp, Homo sapiens
tttgttcacataacgccaccatcaacttaaagtgaattgtctttgttataaatgaggtcactatggacttaccctaaagatcttctgtacttctctcttccataggacaaatgataagtactacatacctcatctcttgggttattattgtagtcttgcattcatggttatgaatttaaaaataaataccaattatggaaatagtactaaaggcttgccgcacatgaaacattattttaattggtttaaagtccctttataaagagtgctacatggtttagataaaggaaacatataactattgagttacaggggattttattaattataaaatgcaatcaatttaaattacgtaggtttaagactagtcccttggataagccccaagcgaatttgtcttcagattattaaaattagtgctgtaaatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttattgtagaaaaacccaaactgagactcttaagttttgtttagcaatgtgtttctggtatgaaacaaactactgtgtcactgtccaggtaggaaacaattctttcaactgggttttcagcataaatgggaactgatgtagaaggcaggatttagcccttctaggcaaaagaaaagctcagttgggtttcacgagtgttcctgtgcttatattcagtctgtgcctacatgttctcatgcatgtctaacctgatttacctcttacctgtaacctaccttatcatgtggcttttaattgacagtcactcagccatttctaagcagatatagtagtacctttcagaactcacattggcaagtgtaaaaagatgacttaaggtgaagtgaggacaaaatcacattctgcatactaacctatttttttctccctttaaggtgctaaacttgcacctcatgtccactcagtaacaagtattgggacgtagagcacagcctcactcagctctgaaaggtaatacagcttgtgaggaagtgagccagcagtggcctttgcaattgtggatcttgagctctgctctcagcagatttcaggtgtaaccatttgttaactgtactgaaggtgtgtcctcaagaagaaagtgttcaaattaaaaaagctgctgccaagtacactgtgtggtcttctcctttgaatcctagggttctatccctcttcagagtcatgtttctggtgctgctactttaaaacacagctcacaagaataactaacttgctcaaatatggagaaaactcaatagggttcagggaggttctggcagtgtgcagtgtgaaataatcctgagtccttgctgaacacaactgtaggcttgagttataaagcacattccaaattttaaataaaagcatttactcaattattataaaacaacatatttaaaaagatgaaccacaccaaaggtcatcaaaacacctttttataaattagataattctacctgttttacaatatgggtttaagccttcaatggtgttcagttcaggtgtgagtcagctcctggtggtgtcagaagtttacatgattgcggatatcattgatttgcttcaccatttcccttatatgttcacccctgtaaaattgtaaagtcactcacttttggaattataata

SEQ ID NO: 10445 - DNA, 1312 bp, Homo sapiens
ccctggggaacagtgtgtcccttgggaacttcctgtccctattttagcagaaatttaaacacttttctagcttagaccagcccagcagggggagagaggtggggagtgagggaagagggttaaaacctgatgagtttcatgctgtcagtggccccctttcttcccctgagtctagcttgtcctggagaacccttcagtttcccaatattgtttcttctcaggttggacaagaagacgaggctgagagtgacatcttctctatcagggaagttagctttcagtccactggcgagtctgaatggaaggatactaattatacactcaacacagattccttggactgggtgagtgcttgataaggtgggggaaccttttgggccttggaaggaagggtcctagttcaaggggagaaaaaagcattttaatgttcattacagatttttttttaactagtaaatattgttctttgcaggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggctcctcagagggaatgagttgtcttcaaccccatagaatgatgtgagtccaagctggctctagaggatcacagcccaagtatcacaggcctaggtttaaacaggaaaataattagcttaaattgtattctagtcatgaaagatatctgataaaagttgtaatcaatgagaattctacacattagatgaggtctcctgagtccagtttcaattagttcagtagtgtagtttgtcatgatgaccgcccctctttggcattgctggacctctgtcctgcagccttcaaacaactgccctgggaaccatc

SEQ ID NO: 10446 - DNA, 1198 bp, Homo sapiens
tcagaaatgtggaaggagattagagtcctgctttggggcaggtaaaaggagggcaggagaaggggagagtctgtttcctgaggcctaacacacccaacattatcacagaacattgtaacaagggctataggagttacgacccaggaactgtggatgaaaaccaatacatatatatatcataacaccacagcctcctagaggaaagtgaccgtggaagggtctggtgagagctggcgggagacaagagtgcattccacgcagcccaaaagccttgcgtgctttgagaacagcaggtggaaagtgggtaagcggccactagagggaattaaacagcttcggacagcggactcggcagcgcagcaagaaagctccggaatccggattcgaggcttcccgggctgcaccggagtctccagcagagggcgcgattccgcccgctggccttaggtcgtcagagcgccggcgcgggaagcgcttccgggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggtgaggtttagcgggccgggggtgtggtttgcgttcaacagagggaaaacgtagaccaggaatagggcctgcaaccgacctctgaggtctgggacatttttccattgattggcaaccagcgggctaaacccacgtatgatcatatttcccccacctcccctatccagcagtttcgttttcttttggtagggggtgaataaaattaaatactagggtacctttttccttagtcttattctatcgaaagtggacctttgggaaggcccatggtcgtggttgaaaatagcatagttatatcgtttggcaagtggaagaggattggaaattctcctggtttatagcggaaagtggtaatgcgttcattgttggaaatcacttttccagaatcaggc

SEQ ID NO: 10447 - DNA, 1185 bp, Homo sapiens
gacctgctggacaaattctaaaagagctagagctgtaacacttattcttgcatcttattaattttctatgatattttttccttcttcgtagggacttgggacaatctggctttgctgctttctaactgctaggcacctctctctaaccctcattgtcagagggaattggaggatatccacagtctgttcctgttctgatattctgagcagagaaaaggcactaacggttcctcttagctatttaattatcagaagcaagtaatctttccccagataatattttgccctagaagaagccgtgatttagctcttttattgtgcttacttggtccaaatacatctgtggggtgttttgtcatttcttaatgaatgaatcatagttataaccaggggccaagctgcccaagaggctcttcagagatcatggatgctctctttctggaagctgtggcctgatggagcagccccattccagggtcccatctgtccggagttgtgtatgtcaagtccggctcagtctttatttccaacactagccgtggtcctgtgcagtcaagctctcagctagtgtttagggctgtctgtcagaaatggttatacgtgggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatttttaatcattcatagtgctggtaaaaaaaaaaaaaaaaaaaaaaaaattggggggtggccgggcgcagtggctcacacctgtaatcccagcactttgggaggccaaggcgggcggatcacctcatgcctgtaatcccagcattgggatgggaggctgaggtgggtggattgcttgagaagttcaagaccagcctggccaacatggcaaaaccccgtctctactaaaaatagaaaacttagctgggcatggtggcacacgcctgtaatcccagctaccggggaggctgaggcacaagaattgcttgaacttgggaggcagagtttgtagtgagccaagatcacgccactgcattccagcctggccgacagtgtgagacggtctcagaaaa

SEQ ID NO: 10448 - DNA, 1270 bp, Homo sapiens
tctggtccgtgctcctccagctgggccttcttcccctgaccttgctgatccttggtgaccacctccgaatgtcagaatccacatcgttaggctcacaatgtgggctgcttttgccccagtgggtccagttgccccaacacgctgtgtagtgctgaccagtgtttacgtgtggggtcggctccattcctcgctttctcccgaaacagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctcagtgcgtgaccctgtcagtgctttcaggagacatgtaagc

SEQ ID NO: 10449 - DNA, 1212 bp, Homo sapiens
ggtagctttccagaatgtgacattgtcctcagaaagatagacataggcttaaacataatggacatcctaaataggaattttcagattgtttttgaagtgaaaagtgttttaatgtctttaaatggaattgcataactaatggtatttaagtattttacatgttgctaataactttgaatatgattgttgcaattttatggaacctgggtctatgggactgctttttaagcagtttaaaaaaggttttcaaagtttaaaagccaatcttagcatgtataatccttatgggattcttaagttttatcctatcttgtttttgctcaagaacgctttatcagtgacgtttgttagaattttgttttttgttttttttttttaaattgtttttgggctagaaatgagtttctctagttttatttgttctccctgagttggagttatgcaatgaatggcatttttgtggtaaaatactaatcctaaaatctgttaactcactgttcatttaagtagggaatatctgtatacattaatgactaggtaaaacaggaaatacattttgaatatacagcctaaaggcaggcagttacagggtttttgatttctccgattttatagggtgcaagttcccagtggcaggatgccctgctgtgtgactgactacactgtgtcctgagcagtggtaatttcaatcacctctcatcagtttggccagccctacaaccaccattcctagccctgtgttgcttgacaggatacctgtgcttgaatggacataaggaaaagtccttactttctccccaatttacctctcaatcttagttcttccagaacacacttccctttcacaatgcaaataaactgaaagtgagatttgatacatggaattttgagaccaaccaactaaccttacacataatttgagggattcctggattcttctagtgatactgaaaagcacacttgactaaagcatagtgttttttgtttgttatggaaatacggtatacgttcatttaaaaataaatggacatacaaattgcatctccttaggagatacattttatatacatttcggtgcgtttttttccagtatggatttctatttgtttctctcttcctcttgttttttctgtgtcactcttgtatgtcctcatatctttcatacctcttgtgtagtctctagaagcagaacacctaagtcctgggtctgga

SEQ ID NO: 10450 - DNA, 1200 bp, Homo sapiens
gacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcaacccctcctacaccatgctccggggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctctggggtcccacactggggtcatgagagctagttagtactcagcctgacccctaggtctggtcctgccagcctgggatgggggtcaatgtatgctacacatc

SEQ ID NO: 10451 - DNA, 1133 bp, Homo sapiens
gttttcgagacagggtctcactctgtcgcccaggctggagtgccatggtgcgatctcggctcactgcaacctccgcctcccgggttcaagcgactctcatgcctcagccacccaagtagctgggattacaggcacccgccaccgcgcctggctaatttttttttgcatttttagtagaaatggggttacaccatgttggccaggctggtctcaaaatcctgacctcaggtgatctgcctgcctcggcctcccaaagtactgggattataggcgtgagccaccgcgcccggcctaacttttggttttgtctgtgctaacctttccatttgcctgttccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccaggcaagtgggatagtgcttcaccccggggctggtggccttttaacctgggcacaatccctgctgtctgacctcccagacaccaactgggccctaggggtttcttggcaccccctgtggctacctggagccaggggcaccctgagcagcgtcatattgtattattattattcttactgttaaatgtgtgtcctgctttagcagatatccagtgcatgtatttgctcatcagaaaatgagaaaacaggctgggcgcagtggctcacacctgtaatcccagcactttgggaggccgaggcgggtggatcacctgaggtcaggagttggagaccagtctggccaacatggtgaaacctcatctctactaaaaatacaaaattggctgggcgtggtggtgcacgcctgtaatcccagctccttgggaggttgaggcaggagaatcgcttgaactcgggaggtggaagttgcattgagctgagatcgcgccactgcactccagcc

SEQ ID NO: 10452 - DNA, 1321 bp, Homo sapiens
tccccttctctctagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactatttgcatttgacatctgttccctttcaccggcaacctccaacctcccccgccctcccacaccactctgggctatagatttgtaatttgtggtttggggtctggccctcatccacctctgctccgagccagtctgcccccaatcccaccccagggagaacatgtagaaagggaaaggtttctcaacttagttcagaccaaaacacattgtaaaggcaaagaaggtttttatttaagtgacaacatttgagagctaaaaaccagctcacatcaaaatcaag

SEQ ID NO: 10453 - DNA, 1217 bp, Homo sapiens
ccgtcagcggccatgggggacgagacaagcggcggagacagccgacgccgccggggcgaatgaggctttgggagctcctgggaccccaggctccatcgaggctgcaagggaccctggggctgtgtgggtgaacggggctgtgggggagcccgaggtggtggggcttgccggggctgtgtgggtgaccgggtctggggaggaggagaccgaagatagaagtccccggggctgcgagagaaaaggtcgcccgggatctctgggccatgagagcattctgcacctgtggctgaaggtgcaggctatgagggccgcctcgggatgtggggaaggaagtagagtcgagctccatcccgtgcctgcaggagagggacctgtcgaaaggggtgttcctggccgagcttcctgggtagagacaagccgcggcggtcttacagggccctgggtgaaggaacaggcaagggggatccctcgggccccctcagggcccacagctctgggcttaggggcagcttacgagagagccttaggcttctgtggacagggacaggctgggagggtgcctcctgcgagtgtgcctggggctttggcgtcaagttctgaaatggccccgcacctgtggaggggagaagctgtgggggttcctgagactggggaggagataggctatgggtttgtctcaggcccttgtgaaaaagaacagactatgggcgagcctgggaccgtggggtggactggggctgtgggagcgcccagagccatggagggagagctcggctgtggcggtgctgcaggtctgtgggggagaggacagtccccgcagattcctggggctctgacacatgaagcagtctgtggggccacccctggcgtatgggggaggggacaggctgtgggggtgtccgatgctgtggaggaggagcctacttctgtgggtgccgcaggtgtgtgttacaggagacaggctgtggaggagacagactctgtgggtatgcccggcccgtggggcacaggatactctgttggggtgccctgtgctgctgaagaggaaactagatgtggaggtgacccagggttcagggaaaggggacagcctgtgtgggtggagacaggctctgggggtgatccagggtcacggggagctgcgcagactgcagagtcatcatgtcctggggagcaggcagcaggttctgggggtgccccaggcctgtgggggatac

SEQ ID NO: 10454 - DNA, 1252 bp, Homo sapiens
ctagggtcagaattacgtctgggaggcccggtgcttagggcccctaggttagaggacttggagaggagagcggctttcttgagaatgtggttaggagccagggagtcagacctcagcggccatcccaaacccaccaccttaggtgtgacctctttaggtattttacttttctgtgcttctcagtccacctctgcaaaatggctatgacagatctcaccccataggatggtcaagaagattgaataaagtaatacacgtaacagcgcctaaacaggtgtcgggcacatagtgctcagaaaatgttggctcctattaaagtttgacccctttgcttcattcccacccccaggaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttcagccctgtgtctgtgcttgagtgggggcgagcacggggctgagactagaggtcggcctctgcctggaaagtcccgatgtctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctccgggcgggacggggagggcgggcgccggccccccgtgacgc

SEQ ID NO: 10455 - DNA, 1252 bp, Homo sapiens; identical to SEQ ID NO: 10454

SEQ ID NO: 10456 - DNA, 1252 bp, Homo sapiens; identical to SEQ ID NO: 10454

SEQ ID NO: 10457 - DNA, 1172 bp, Homo sapiens
gaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgagaggttcgggctggggcgaggggtttgagggtgttgtggatccaacagctcaggcagaataccaaacaaacctttttttccccaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtattttt

SEQ ID NO: 10458 - DNA, 1141 bp, Homo sapiens
gagctgaggatgccttgtttttctttgtcaacaatgtcattccacccaccagtgccacaatgggtcagctgtaccaggtatggtgactgggaagtggtggaggctttggagaggaatcttggaagagcgtgaggggaagaaagtgttgttacatcagtagttttggactagcttcctggcttgccttaaagtttcataatagccgtgggttgggggtttggacagaacagtaggagtagagagaaggaaagagaacagtgagctagagaaactatctgttcgggactcttcccagtccccctccccattccaaagcagcagaaaacagtttgaggcctttttgcccaggactgcagagattatactgctcgtgtggtaggccttggagtcagtgaaggagtcaggcaatggtttgtggttctagaagaacgtgtctgggtcgtggttggtttaagttactggagcccagttgctgaacagttttctgctttcatcccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgccttgtgttgctcccctcgtcccgctgattttaagtctttccaaggtgtcagtgggtttcagtggtggggaaagaagagtactgggtacaagctggagggatagaagtatattttggtttattctgttcat

SEQ ID NO: 10459 - DNA, 2159 bp, Homo sapiens
ttaggtcccacatctccagtgatgctgccttacaagagtgttgtgagggtatgaactataaggtactctaccaatgcaagttattgtcaccccaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaaaccatgcattataactttgaaaccaaagcggccttaggtccttctctggggttttgggaagtgaagagaggggactttgttcacatgcaccctgtcccacaggcagagggggaagagactgctgttggactcaaggggcagggggaaaggtggcgttgagtatagggatagaataatgcggacaccagatgcctgggatacaataatgctgacaccagatgctttggcgggaagggccgagtgacaggatgggcgcgctggtggggagtggaaggacaccttcggagaagcaggctatggaagcacgaaaggagaaaccggctatggaagcacgaaaggagaaacctggacggccaaagggcgtagagctggagaaaccgggcttcgtccggggcactgacgtggacaggttaagcgggcgctgcccccaggtggctggcgccccgacctccgctgtccgggaaggcgtcggtccccctcccagctgtcgcccagccggccccgcctccccggcgccctcccaagccggccctacttcgcgcacccgccacgtgacgctccgccctctttgagatcacatgatttaactcaagtcccgcagtgttcctccgcgctggcgtagtccctacctttccaacctcctctccagtccctattggtctactcattttggcacttaagcgttctgtagatctctccaaacatctgttttctttttgacttcttatttctggagatcatctccgccacttgggtactactttgttttggtgtcaacggccgccttcagcgtagcaacacggttcgtgaatagctaaccttgtaattgtccctgctgttcctctacgttgttaacgaaaggaacttggagaaccaagtctcgtatgatgattaccatcttttactcctcttcagccccagcttccttgaggggacggttggggaataggtttagagtaattttcgatgagcaaaagccaaccgtctttgctacgtcgcctgcgtagcccacaaattgattccaaagcgattacgctaatggcgtgagggggccggtcagttggtggtgctacgctagcagcgttagcgccgctgaggtagtggcgtatcttagcggggggggcagtccccgatagtcgggggcggggttggtgaatagggaagtggcgcaaattcgtggatcgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgaggacagtagccagggccgagggcgcgggacgcttacgctgacgccacagcctggc

SEQ ID NO: 10460 - DNA, 2159 bp, Homo sapiens; identical to SEQ ID NO: 10459

SEQ ID NO: 10461 - DNA, 1169 bp, Homo sapiens
cagcatcacctgacatccgaattctcaggtcccaccccagacctggtgaatcaatcagagctggggctggggctccacaatcggtttaacgagctctccaggtgattctgatgcacgctacagcttgagaaccactgcttggtggaaagagctctcactgggactgaggtaagaagcacagtgcattctacccactttgcgactgaaggctgtccctgccttttgctttggagttcatatttcttgcctccctttctgaaatccctgaggggtaaagcggggcgggaggggaggtgcggggagtgcatcctggggatggtggtaactgcacaatctgctgaggccctgagttcaggacttttcccctgctaaactttgaccacctccttgctccaccctccagctctagaccccaagtcaaatgttgaaagaatgaaattgggtggtggccccagcaggggtgacagagactcctgtcttgctgtctcacttttcacatggccttttccccaatcagacagctattaaaagaaacaaccccaggaagtttctgcgcagcgttggagatggggagactgtggaatttgatgtcgtggaaggagagaaggtttggggactgctatggggtatagagttgactaggcttacgggagggtggcctggaggtcatcacaggctaagaccctcctggggccagctctgacccgttctgcgggaatgggactgtgttctctcaccctgatgtcctcttccttaatgctagggctaagggatgtcctaagtatgtccctgtcatcggtcggcagtgtctgggtttcttctctagttcaccaagcacttcgacatccgttctccacgtggggccctgtcctagacttcccgagtccgcctctggagtaaaaaggtggatgctggctgccaggcctttctccacccagtcgtatactcaggagggtgcagtagcaattatttcaaaaggacatgttgctccttcccaaatgggtgcaagcacattccactgcctctccagggagggtagaaagaagttagaggagctaaaggaaagctggagaggggtcttcccctgaaagaaggggaagcaagttgggaaatgcacattggctgttggagcaggttctcactattcccttaccaccttcccagggcgc

SEQ ID NO: 10462 - DNA, 1111 bp, Homo sapiens
cttgtggtttcctgtagcagtgactggtttgtgtgtggatgggggggggcagtgtaacagatgggtggggccttgtcctccggtctccaccctccccccccccaattagccctgcccttttgctggatcatagctgctcacctaattatagccctggctatatgtggggaagaggggtggttggtttcagtggcaagtaacacctgagtcctccccactcccaggaagtaggccttttctcatctctgagatttgacattccagctccctagagccttcctttcccaagccaccactttagctttgatttatgggggagaaaccagctattccaccctcccatacacacaccagttcttgagtatatttgagcccagtcagtattttaagttcaggaactttgactttattttaggtgggtaatggaataaagagttgggaaaatgtttctggagagaaatgggatagattggaggtcctgttgacctccatgcttattcacttcagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggttagaatttcacctccgcatcttgccttccccatgcctccagtatctttggcgctcccagcagcaagctgccaacagtgctgactttcctttaactctgcttttactgtctgattgtttttgtttagcgctcagccttcatacccattcagacaactacacctgctccccagtcttcagcctcttctgtggttacccttctgtccccgcatcattctctggcagtccctccgtttctccagctttgtgccaatctcttcaattcataggcctttatgctctagctattcagttgctccttccttattcttggttttcactttttctttcttcccttgagccgttgttaagtggttgcttccatcacgttgcccagggtttctccaattctacgccttcc

SEQ ID NO: 10463 - DNA, 1568 bp, Homo sapiens
ctccttccctatctgcccccagctgattggcatccaggatgggtacctatcactgctccaggacagcggggaggtacgagaggaccttcgtctccctgagggagaccttggcaaggagattgagcagaagtacgactgtggagaagagatcctggtatggtgcctccctccctgcttctgtgctcagctttgttctgtacgtttcttcctgagctcagacatctcttggctatccctcttgcttctccagatcacggtgctgtctgccatgacagaggaggcagctgttgcaatcaaggccatggcaaaataactggctcccaggtgagtgtgacaaatccctcactgtccccttcacattttgttgtcctcagcagagctgctgtagtcttaattgtttcaggcttactttctgcccctagcctggctctgtcctccctatccttcctgttgaaggtattatcctgtcttactaatttctctctcctacctagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaactcagctgcttatttgaattaaatgggtgtatttggaagccacaaaaagactgaactctgccactgagttcactggaacccgctgtctatcactttgacttgctgtggacctgccagccatccccccaccctccaagcaaccttgacctattccagacagttgggtgggaggcaacacaaacagcagcagccaggggcagtggcaggtagattttattggcctgggacacacaggggataccctcacccacgatggggtggggggtgtggtgttgaagatataatctgatggtcacttgtggtagaatcgcgggttctggctgtgttggatgaaggggagccgagggccaggttggctggtagctgcaaagcccgactggtggtggtgatgaaaagagggctttgtcactgggcatactctcccttccactt

SEQ ID NO: 10464 - DNA, 1248 bp, Homo sapiens
aagtgaagggtgtagctgagcaggctttgggaggaagagcatttcaggtagaacagctagagcgaagttcccataaggtgggagtatttcctaggtacagcaaggcttgtgtggttggaacagactttgcaagggggaggtgatggggcgagaggcttcactcccttattttttcttgtctgacagattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagtcgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggtaggaagggcagtcgtccgcgctggctgggcagggagcggcagcagcgagccggggaccccggc

SEQ ID NO: 10465 - DNA, 1248 bp, Homo sapiens; identical to SEQ ID NO: 10464

SEQ ID NO: 10466 - DNA, 1218 bp, Homo sapiens
tggagagagaaggcagagggatagggagaaggaggagggagcaagatgtggcagacagagatgaggagagaaaatgggggagacagtgatggggaaagacaggagagagagacagaaggcttaagggggaaatttggggaaggcatttggagagagagaaagaaatgagaaacaccaaggagagagatacagaagagaaagatgtaaaaagaccgagggtgagagactgaaggcaagagctggggcaagctggaagaggcccacaaaagatgctcccagggagcactacggagaggagagagatgggggggcctccagtgggagggaaggagggagcggagctggtgggaggaggccaggggcccagagtaccctcaagaggagagggtgactgaggcagatcttgttgtggggagggggagggggcagcaaggccatggtagctgagcccagtctggcacaggaaaaggagatcctgggggaatcagccccgagccacctccaggtgatggaggaatagaggagccttagagaagctgaaaggcagggggcatgactgggtgtgtgtggtaaggattcctgtgtcctcatctctggaataaattgacacctgcagagagccacccgcgggctggcgcctggctctgaaaaccccgcgtcagcaaacagctctggcggctggtgggggggcggggggggggcttgccgaaatgacctgggtgtctgcccctccggtctgatcttctcccttggctggcccctgctgccctgagcacccaggcatcagagcagcaactgtagggggggtggcaaggggaagggtaggtgaatggatgggttgggatgggaagagaagaaagctcagtgttgcccccaggacatgggtcacaatggcttgcaaagatgaaaaggtggtggggtccaaggttgcttgaaattgctggaggggggcagtcagtaggctcctgtgatgtctcttcaagcccacctcagcaccccctctcccaagccagaggcctggtcactaaggctaggctttgattggccaacaggcagggcttttagcgttcttggtgcccccaatctccccctcctctcaacatatatacttcttcctctatgttaaggttggggggaactcttgcattctgactcacgcctttgccctccccttcatgccctgaatggaccaccaaaccaagccagccccttcccgtc

SEQ ID NO: 10467 - DNA, 1493 bp, Homo sapiens
cacagaccagggaccctaggcctggcacccctcacccaccgaccagggtgccatgtggagtggaggcccaaggcctgagtcggaggagacaccaggaccctcccagcagctccagctccagttctagcctcgggagcttgctcttcccagggacaggaaggagatgtgctgtgtgcgggggtgctgggggttccctggatccagcagatgccctaaggagggccactgcccacccccagcctctacggggtttcttggaaagtctgcattggagaagtgccgcggggaaggctggcagagggtggggagggaatgtctgccagggctagctggggagggaggaggggaatccggtcttgccccccagggatgggagtgacatgtcccctgagctccaggccagtcctcagcaggcctgggagctgggcgctgctgcttccggtctgactgtgtccttgtccctgaccccctggcccacctgcccacccctccccacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggtgagggtgggcagccaactctggggctcgggggagtctgggaggtgggcctggtgggcagggttcctccacatccagcagaatggcttctgggctggactgagctgcccagaaagggggcaggggcgctgtgacacctccagggagccctcttcttctctactcccaggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaaggtaccagcagtgtcccagcctgttccacccttcccaaccctgccaactcccccctctccttcaggccggtactcacagcctggcctgaggtctgcctgtcccgccagggctgttccagaaggccatcgcccagagtggcaccgccatttccagctggtctgtcaactaccagccgctcaagtacacgcggctgctggcagccaaggtgggctgtgaccgagaggacagcgctgaagctgtggagtgtctgcgccggaagccctcccgggagctggtggaccaggacgtgcagcctgcccggtatggggtgggagagggctgggtccaggccttcaaggttccaaggaggctgaggtgagaggtgcctgtgggcataccatttggcaaggagggatgggcttctggcccccagtaagtggcctcctcttgcaagccttccttcagtggaggtgctcaatcagagcaggtgagcacagggtgccatgaag

SEQ ID NO: 10468 - DNA, 3219 bp, Homo sapiens
gccaacaaggtggccttctggctggagctcgtgccccacctgcacaacctgcacacggagctcttcaccaccaccacgcgcctgcctccctacgccacgcgctggccgcctcgtccccccgctggcgccccgggcacacgccggcccccgccgcctgccaccctgcctcccgagcccgagcccgagcccggcccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttggcccccggggccctgaccctgctgcccagtggcctggggccaccgccacccccaccgcccccctcccttcatcccttcgggcccttccccccgccccctcccaccgccaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttggttgtgcctgctctgttgtggggagggcggtctctaaagaaacaagccctggggaagtgacgagggaggaggggtcttttcagtgaccagctctgaggtctgagaggaagggggagtgtgtgctggggtctggttgccatggtaatgggtctgtttggcaaatgaatgtcaggacccgtgtctatgccgagactggagcctggtgtcgttctataatggaaggacaaaggctgatgggggcagatgtcaaacaggccagaggcccagtgggctggtgtaggcagctagctcagcagaggtatgtgaggtgagaggcatggcctctgccaaggcctggactcaggcgagagggtcagccacgggtccaggactcagggtagccccttggcacactggaagggagtggcctggcaccattgtgacccgttcac

SEQ ID NO: 10469 - DNA, 1203 bp, Homo sapiens
ggcacacaacaatgagctggagcccaccccagggaacactctgcggcagacgtttgagaatcaggtgaaccgcattcttaacgatgcccgagacaagactggctcctctgctcagaaatccctgtctgaatacaataacttcaagtctatggtcgtgtccggagctaaaggttccaagattaacatctcccaggtgagaagccttgtttttccatatacggggccgctgtgaagtttgggaggaggaaggaaggtgtttgtatgtattagggtcaggagaatcacgggagttgggggaaattttgggaactgttattcttaaggcagagggaattcagtatacaccacctttctgtttcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggtgaggctttcctcaggggtcttccttgggctgttagcagggactgctgcaggctgagaaacccctaacaggtggggagcggaaatgctcaggctcctattcccagggtataattctggcccttgtggaaagaatagagtctcaagagtaggcaaacacccttgtttggattgctgtgcagcattgcacagtgcagggacagagcttccggggctctgccggcctgtcccatgggagtggttcctgctgggctttttgtccgtctagtggtagacactgagtttgcattcaaaggcctcagacacagagagtactagctgactcttctgacagtcaggtaggttaaggccccagcctgggtctttgggctttatcatccccttacttccctccaggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagtgaggaggcgggcaggcgggtggttctcgcccctggg

SEQ ID NO: 10470 - DNA, 1103 bp, Homo sapiens
gaacatgggaggtagaggttgcagtgagctgagatcgtggcattgcactccagcccaggctgataacagcgagactccacctcaaaaaaaaaaaaaaaaaagtctcactggaactgtgaggggcagagcctggtgactgactcgtttggccctcaaagaggctgtagttggaggcgagagctggggaagagaccagaggatgccaagtgctgacctcactctcactgcaggaggaagaggtggtggacaagatggatgatgatgtcttcctgcgctgcatcgagtccaacatgctgacagatatgaccctgcagggcatcgagcagatcagcaaggtcagccatcccctctgccaccgccttcctcctcccactcccacactcccctccctgcctactctgagcacgctgtcttcccacaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgagcccgtgtgtgctgcctagctgcctttcgtggatctctggctctcaggcccctcattctgtgctgtccactcaggactttttctgcctgattccatttctgagtgtgggatatcctggctcctgacaccctccctggatctgggtggcgacagaagcagggaagagagcagagttgctcagtcctggccctcccctccacttccctcccctgtgccaggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtaacagtggaatttctgaatagggcagaaggagggagtagtgtgagaagaagggcacacactttgggcagct

SEQ ID NO: 10471 - DNA, 1218 bp, Homo sapiens
acaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaagtatgtacatcgagtgcttcattggggttcaggagacccccaggcccctgcctcctgcctgggctgctgcttgatctgttagggggaggggaccaggaaaatgggagggtaccttacagtcagcccacacacagcccctgctctgtgccaggcactgctctgtactgagtttgttatagtcacaacagatgcagctcttgtcctctattaaggtgatattgaccataacagctttttaacttgttttactgattgtcataaataatttggaaaagtgtagaaaagtataatgcagagggagaaaaatgatcacccataatcccaccactaggaggcatactttctttggtattttttcctatacttttcttgagtcactaaca

SEQ ID NO: 10472 - DNA, 2425 bp, Homo sapiens
agctggaggacattttccagcaggagttttccaccccttccaggtgaggcttgaaagccctccttgaaagaagggctggggccttggggatgtggagagaatactgctgccttttcttccatagggctgtagttggggaggaggaagctagagctgaaggggaggactctgcaggcaggtgccaaatccttggaagctgatgggagagtctttacctgggaccctgaaatgttctacctgagtagtcatgtttatctttctggggagtgggcctttcgcaggtcctcagaaggacccatcatgagccagaaaaaagggagtcagttagaatttgtattccagggagtagtaggtatttctgtgtgccccagctgcatcatcttttgtgtgactccacccttggcctactcaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgagaaagggtagagaaacaggcctgagaggggattcagggagcagggtgtctggggccctctgcatgggggagccctgtacccatgccgcaccctccatggcaagctgcctcccatcttctccccaggtgatgaacatgtatggagacctggtcatggacacagtccctgaaaaggtaggcccaaccagataggtcagtacccagaggaacttctgcagttttaagcagctttttaagctcctttcatctctttcattttacacagagagggtctctgtttcagggagagaggtggtagtggtagtgtattaatttcaaatccgtaatcttgggctctggatttatcagttgttttcctttctgccagtatttagtgtttttcgctatggccagccccaaggattgggatgggttcctattgtaactattgtaaaacaagatttaaaaaaaaaaagaaaaagaaaaaggccaccgggcatggtagctcatgcctgtaatcccagcactctgggagaccagggcgggtggatcacctgaggtcgggagttcaagaccagcctgaccaatatggagaaatcccgtctctactaaaaatacaaaattagccgggcatggtggtgcatgcctataatcccagttactcgggaggctgagggaggagaactgcttgaacccgtgaggcggaggttgcggtgagtcgagatccacgccattgcactcccgcctgggcaacaagagcggaattctgtctcaaaaaaaaaaaaaaagacaaaaaacaacttcggctgggtgcggtgactcattcctgtaatcccagcactttgggaggccaaggcgggtggatcacccgaggtcaggagttccagaccagcctggccaacatggtgaaaccctggctcaactaaaaatataaaaatacaaaaaagttagctgggcatagtggcgggtacctgtagtcccagctactcgggaggctgaggcgggagaatcgcttgaacccgggaggcggaggttgcagcgagtcgaaatcatgccactgcactccagcgtgggcgacagagcaaggccctgcctcaaataaaaaaaaaaaaaaagcctggtttgttgactcatacctataatctcaatgctctggaaggccgaggcaggcagacagacagattgaggccaggagtttgagaccaacctgggcaacatagtgagaccctgtctctaccaaaaaaaaaagaaaaaacccagaatttgtttttactgtcagtggactgaggaggggagacttagtgggagagtctgaggtcttttaattccattgagcttttttgtgtcattggcacaggtgcatttcttcaatagtttcttctatgataaactccgtaccaaagggttatgatggggtgaaaaggtggaccaaaaacgtgagttttgaattcacatccacttgtgtaatgccttgcctctaaagaatgagagtcttgttttctctgagccctttccctgaccgtgttcattcagtctttcaaagattaaacgtctcttgtgtgtgtaggcactaaggatacagtgttaaataaggaaaacttgcccttaaagttaaattgcagctagtgataagtgctgtgggcagatcaacacagagtaacgtgaggctgggcgcagtggctcacgcctgtaatccccagcactttgggaggccaacacgggcggatcacctgaggtcaggagttcgagactagcctggccaacattgagaaaccccatctctattaaaaatacaaaaattagccctgtgtgatggcaggtggcctgtaagcccagctattcctggaggcggaggcaggagaatcccatgaacctgggaggca

SEQ ID NO: 10473 - DNA, 2425 bp, Homo sapiens; identical to SEQ ID NO: 10472

SEQ ID NO: 10474 - DNA, 2672 bp, Homo sapiens
gtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaactgacatatgagcacctgcctctctctgctcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtctttgtactctgagagcagactacttggctcctctctgttttttatcagcgaagttggatatatctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccatatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaac

SEQ ID NO: 10475 - DNA, 2672 bp, Homo sapiens; identical to SEQ ID NO: 10474

SEQ ID NO: 10476 - DNA, 2672 bp, Homo sapiens; identical to SEQ ID NO: 10474

SEQ ID NO: 10477 - DNA, 2672 bp, Homo sapiens; identical to SEQ ID NO: 10474

SEQ ID NO: 10478 - DNA, 1484 bp, Homo sapiens
tctagaaggcactaaaacctcgtcttacttctcccagctaagggccaaagctgccccgtgaggaacctttgtccataagggaacctttcttgagctatgctgaagggtaaccctggctctgtctcttgcaaccaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaatataattgtatgttgtgcggctctccctggctatcatgggaggactgcaggctgcctctgaactgtagtccaacaggagaaagggttgacagcctggggtaggggatgctgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgccacccacccagccctggctacccagcccgctgggcgcagcaggcatggaagccgaccccgggatggagagcccgcggccctgttggggcacgctcgggagcgggcttgcgtgctgcacggctgttttcctcttggggagtca

SEQ ID NO: 10479 - DNA, 2372 bp, Homo sapiens
ctggcgacagggatcccccaacccgaggggaagaaagccggaggcggccgactgggggccggggtaggggacccccacctgccccccggcccacttcgagatacaattcttcatctattagctcaggtaccagacagctgggttcatgaatatgggccaaaaggaaagatgatgggcacctgactgccaactcctcctcttcttcctctgaccagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctgggtgagggtgtgcctggggtctggaaagttagagatgggtaggaatcgagggtgggaggttggatgtgtgactctggttttttcctaccctacagaagatgaatcaagacctcaacgtcgtaatcgcagccgccgccgccgtaaccgtggtaatcggactgatggctctatcagtggagaccgccagccaggtcagccaactctggacaccagaatccttcctcagagctgagagaatgggatgctcacccctgtgaaaatcaggggttcgggttcagtgggtgtcttaggctggctaccagaattccatctgaaagtcttaatctcctgccttccccagtgactgtggctgactatatctcacgagcagagtctcagagccgccagaggccacccctggaacgcactaaaccctcagaagactctctttcaggacagaaggtaggcaggcaagatgtgctttaccccatcccttttttgttgttactctggggcagggggcacaaaaaatttcacaaatctcctactgaattgcagaggcagctgtgtctgatggagtttagaccagtgtaaactttgaataggatagagaagaaagtgtggttcacattttctggatcccaagtaagagagactggatcatgagatcagggaaccaacctctggatcaccaaatgccaggagggcttggatggtagggaatgtctcccacctgaatttctactcaccgcttcttgcttttctgttttctttcccactttcccctcagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggctgtctggctcctgtgccttctttgtccccagtttggtccatttgtttctctaggactgacctgccctggcccctggctcttgttttctgttcctccacatctgacttctcttcattgtctcttgtcccaaagatggtcttacttctgggaattcctgacattcctaaactccccaggcccaggttctccctcctggttcagaggaggggggcttgtgccttgttgcttctcccctcccccaagtttgctggtagagggagttgggccactcctataccctgagtcacagcacaggctaggcagggctgctcagagctggagctgttcctgtagaagctgagagccaaggcaggctgcttaatccgattacctgaggcctggggcttgggctgggccgttgggcagagtggggagcagggttccctcacagcagcctctggagcccggggtccggccttcttggtggtgttctgttctggctccaggcttttt

SEQ ID NO: 10480 - DNA, 1211 bp, Homo sapiens
tgtgttcaaagtttggcttctgaagggcaccaggagagagatgttgctattcaaatctgagggtccagtctctgcggggtggtatgagggtttgcttgtgaatggtggccagtacccgctttaaaaggcaccatgctagcacagctttaagcatgagtacgaatgcagaggtaacagatgtgtgccttgtcaggactatgcatggttgagaagttggaaatgtaattggaggcaaaataacagacctccacaaggtcgggcttcactgtgccctaggaccaggagggggctgggagtcatggctagaagccagacacaactgcctgtttccagtttgtctcattttgcctccagaggaaggctctaagacatccctgtggctctgtgatcagtcccagtgcagaacttcagagtgggtagaggggtgtgtggggatagttgaggttatggtgggaaccttgggccctgctgaccctgtttcctcctccctagcctttatcctcctcttctacctcgttttttatgggttcctcaccgccatgttcaccctcaccatgtgggtgatgctgcagactgtctccgaccatacccccaagtaccaggaccgactggccacaccgggtgagtgtggaggctccccctgccagctactctaactgctcttgtgcccccaaacctccagaaggaactcatagttccttccaggagtttgattttgatgacccaatccccacgtgcttggaagttcttgaaatctgtccaccttcccatttactgcagttgggagctgtgtgatttgggcatgtggcagatagccacaggagatcaccctcccatgaagacgatctcagatattcaccgctgtccccactctggtgttccctgtgtccattttcttccctctgtgtgcagtccctcatcttatagatacccccaacttctgcctttgttggctgtaggcttgatgattcgccccaagactgagaaccttgatgtcattgtcaatgtcagtgacactgaaagctgggaccagcatgttcagaagctcaacaagttcttggagcgtgagtgtgggcctggttatgtgtcagttcaagacttcgggcaggggactggggaccttggaagtggaacatctggcccctgagtctctccctcccacctctttagcttacaacgactctatccaagcccaaaagaatgatgtctgc

SEQ ID NO: 10481 - DNA, 1520 bp, Homo sapiens
ttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtgaacgccagtgcaggctactggggtcagcaggtgcaggggtgagtgaggaggtgctgggaagcagccacctgagtctgcaatgagtgtgggctggggggcccagtgcccgggttccgggaggggaacaaaggctggagactgggtcagtctgcgggctgcatgacaacaagggagggggtggctccattcataactcaggaaccaaccgtccctcctcccctccggccacggctggcacaaggttctctccctcccctgcttctaggactgggctgcttccccctcggcagcctctcaccaaggattacgggatttaaatgtctgatttagcaaggctgagcctccagggtggccatctgctccatcagaaagtggcaggatacctgggttcccaagggg

SEQ ID NO: 10482 - DNA, 1151 bp, Homo sapiens
ctggcctcatcttgggcctgtgttatctcctaggttggctctgactgtaccaccatccactacaactacatgtgtaacagttcctgcatgggcggcatgaaccggaggcccatcctcaccatcatcacactggaagactccaggtcaggagccacttgccaccctgcacactggcctgctgtgccccagcctctgcttgcctctgacccctgggcccacctcttaccgatttcttccatactactacccatccacctctcatcacatccccggcggggaatctccttactgctcccactcagttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaaatattgtaagttgaaaatggatttaatacacctaatcta

SEQ ID NO: 10483 - DNA, 1171 bp, Homo sapiens
ctgtcttggcctcccaaagtgctgggattacaggcgtgagccactgcgcccagccacgtataattcttacaactaggaaagtcccttccccttcctgagcttcatgtagcttatttgcaaaatcagaagattataaaggattaaagaaaataatgtgtgttaactggagcagagtagacagtgcacacaagttccctaccccagtctctttccaacccacaccttttctagcatcaccccagattggccccatctgatggaaagttctggccagaagctacaacagtgtactctggtgccctcctccctgccccctagtctggaggccgcctcgcctattgaaacatttgaaggaagggtgcgttaatcacgctttctagcctcttggggcacctctcgctcccagtgactctgccttgcaccccgcagactggagcttggggctgctttgatgagtttaaccgcatcaacatcgaggtgctgtcagtggtggcccaccagatcctgtgcatcctgtctgccctggctgccggcctcacccatttccattttgatggctttgaaataaatctggtgtggtcctgtgggatcttcattaccatgaatcctggtaggtggcagggagtggatgggactcctggggtgggaagaactgggtgttcaggggaaataactgcgcatcctcctcttcccccttccatgcgaatgtatatagctaagtgaagtctggctaaagatagcaaaggggagagaaggataaacacaactttccgggagaaggggaagcaatcttactgttttccccaaagggattaataaccacttatgtgtgtatatgtagccctcatcttttaagatacttagctttcttctccctttaggctagctccaagagttctggtctctctgccatctcttttgcagcaggctctagggtctctcattactgtttcctaggaacaactctgggggaagggtctaggacagcacagggataggaaagggtttaggaactgaacaaagaggaacagctgtgatttctattaggactgatgagagctatacacacagaacctggagagatgggaaattgacagctctgtgatttgagtttgaaacaaggccatgcagaaagtaaggaaaggaccagagataagagagaagaccaaag

SEQ ID NO: 10484 - DNA, 1186 bp, Homo sapiens
gcagaagggccttgcctgcctgacctctaccacctacagctgaccactaccctggcttaggaaggaggccttggtgggtcacaaatagcacctccctgggggcagtgtcatcagcagccacagaagcttgcggaacattgcatcatggagactgggggctagaggcctgagtctctgaggcaaggggaaggatgggggccggaaggctagggaatatagagattagattgggaccccaagtgtttgggtccataagggcagagaactatgattaagggagcagaaaacataggtccctgaggagcgagtctgaggtgagggccaacttagctctgacccctgatggacacctgattcttggccttggacttatgctaaaagacctagcttcttgtctatgagggttgggaagggagtgggcctgtatcaccttcttaggccacataagaggaaggaggtgatggggaaacaggatattgccttggggttggcagggaggggaggcttgcagtggaggctacttccaggcttaggcccagagtcagagttcttgcaggggaggatggcccctccctgttgggcccgttcatctagtctggctacctgtgctgctagccaagacctgcctgcacccgcctgggggaagaagagggggcagagtccagagggtggggttgactgtctggtgtcttgataaggttggagaggacacagagctgaaggaagagggtctgcatgccctggtgctaggactcaggctggcttgtgtacagatgtcagggcagctggggcgactcaggccagggagtctcagcaggagcgtcctgtcagaagagggatcacgggtttggggtctactgtagacttactcagatgccatatcatggccccttaccaactgatcgagcctgcttcccaaaggggaaggttggatgaccactttggggatggctttttctggttgccatggaaacaagattctcccatcatatctgaccaccagagccaggtttctccttaatgaggggggcagggagcccaggaaaattctccatcctggaagacccccacctctaactgacttttttcttttaggttccccccagggcaacatgccagccccgtagcactgcccaccccacccactgtggtctgttgtaccccactgctggggtggtggttccaa

SEQ ID NO: 10485 - DNA, 1450 bp, Homo sapiens
cctgacggccggagtgtcggatcctagatggggaccctaggtgggagccgcggggtcacatcggggtcaccccgggctgagctcgtctgaccggctcccgcgcccctcctcccccggccaccgctgccgggctcacctcgctcccattggttccggccaggctgttactgaggcggagacacgggtgatgattggctttctggggagagaggaagtcctgtgattggccagatctctggagcttgccgacgcggtgtgaggacgctcccacggaggccgggtaagcggccgctgcgttttgggtcggcccagtggctccggactggaagcctggcagcgcagccaccccgtccctctgaccggccttttggttccctgccacacacgtcctgactcccagccacactcctgggcctctagggagtggttgggccgggcctccctttggggaaagctaaggccgggccctttgcacaaatgacaaattggtggatgccacagtccgcccatcccagcccctgggccttgactgtgtgctggccagctcgtctcactccttttccttctctctagaattggctgtgaaaggactgaggcagccatctgggggtagcgggcactcttatcagagcggctggagccggaccatcgtcccagagagctggggcagggggccgtgcccaatctccagggctcctggggccactgctgacctggtaagggaaactctggggccgagctggctggatgtacactggcagctctggttttgcctccagtaagagcataatttcttatccccaactcaggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcaggtgagaagttggggccctctgtctccaggcacacctctttccatctctgtatccctcaatctgtgtcattctccatgggttcctgtcattctgtgggcttccgtgcatcagccccctcctgcctaggtaggacaagactgctcctttttgccgtatataacagactccttctctctccagatgctcagccagcattgggcagcccccgcttcctgctcccctacccccttcacatggcagtagttctgggcaccccagcaaaccatattatgctccagggtgagtggatatttgaaggttctgggagtgggaggtaaggctggggccttgaaagagtcccctcaagcccaacccccacccacacccccaccccttctgctctgtagggcgcccactccaagacccctccatgggaagctggaatccctgcatggctgtgtgcaggcattgctccgggagccagcccagccagggctttgggaacagcttgggcaactgt

SEQ ID NO: 10486 - DNA, 1099 bp, Homo sapiens
ctcctgccagcaccgagccaaggtcctgcccccactggagcaagtgtggaacttgctacaccttgaggtgaggctggcactgggtgggttagggaggagagccaggctgtgcctgcacccgtgccattttctcttctctctttttgttctcagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacaggtgtgggtataggggggccagcaggcagtaagtaggcaggacttgggaatgggattctcacactctcttctctcctagactggccttcccccagggctgccactgcctccaccaccattaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggtgagcccctgcctgttgcctttcacctctcacctacaagtcccacgctctctattcctcatcctgcatccctgtttatctcctataggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattgtgagtgacaactgagggtggagggggggatgggtggagcttgtcttgaggcagcccgagcaatgctcctac

SEQ ID NO: 10487 - DNA, 2611 bp, Homo sapiens
aacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggtgagatgagaacgtggccagaggcaggtcctgggacggggctgcggtgggagggctctcgaaaggtctctgacccaggcctgcctaccctctggctgaacaggaggagaaggagagtgaggatgaggagtcagaggagccagacagcaccactggaacccctcctaggtactgtgcaggtgtgccccttctgttcctgcttccttcccctccctctgctctccaccaacctgtgctcttcgccccagcagcagcgcaccagacccgaagaaccatcacatcatcaagtttggcaccaacatcgacttgtctgatgctaagcggtcagtggggctgaggccagggaagttggggcaggagtgctgctaggacctcgtggcgggggcggggtgtagcctctcgtcgcacttccgcaccgcaggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggtgcgctccacgcctgtgcgcgctgatgctggaagcgcgagaggaggggctggcggcggcgctcagccgtcagccaatgagggcagagggcggggctatcggggatcgcagttccgacctggccagccatgccgttctctgtcgacccctgcaggccaccaggagaataacaacttctgctccgtcaacatcaacattggcccaggcgactgcgagtggttcgcggtgcacgagcactactgggagaccatcagcgctttctgtgatcggtgcgtgccgtcctgcgcaagtcagactgccgcgtccccgccctcggtccccagttcccacctgacctgtggccaccccgcaggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccggtgagagggtggggcaggtgttggcgtggtgtggcgcctcagcggcaagggcctgggaggctggggcttggagagccgccagcagtgagggaaggggcttgggcctaggtgtctgggggctgtttgagagtcctgttgtgatcgcctttggcccgcagcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagtgaggaccctatttgggtgggagcccacctccactgactggtcccttttcttgttcttcctgtctgactccaccccatttttacctctctccatccttgtctgcctgtgccccgagtgttactgtgttggggaggctaactaggtccttgctgtcatgaccttttctagtggtccaaatagacaaaagccacaggaaacttcgcctataacagatgcccaggacagaggatgtgacctagacatgaagcggggaggcccctaggggagggccctggggctgcccacccctctgcccttgctccagccctgcctcaggcctcctccttgccggtggtctcaacacaaccccactgctccccaggttctgcctgctgcagtccatgaagcactgccaggtgcaacgcgagagcctggtgcgggcagggaagaaaatcgcttaccagggccgtgtcaaggacgagccagcctactactgcaacgagtgcgatgtgagtgggccggctctgctgctctccctgagtgtccacagtggccctccctccccctgactgcactgtcctccctgccccaggtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggtgagggcccggcgggcgcgcgggcagcggaggagggcactggggcaggctgcagggacgggcttcgggagcccggccgcgcctttccctgagcccccgccggctttctccccccaggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaaga

SEQ ID NO: 10488 - DNA, 2093 bp, Homo sapiens
ttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcctgtttcgctaacggctggtggtagcaggttgagtaccgggagggctgcaagaccgtgattgatggggaggactgcgcagaccctggcgagggtgagcccctccccggaggcgcctgtggaatgtccagggctctggtccgctcctcgggatggggggtgcctaatcctagagccgcattccaggataaggggggtggggagaggctgggccgggggaggggcaggaaagagggctataagggcagcggcccaggcgggcgggatccaggcgggccatggcggatgtccccggggcacagcgagcggttcctggtgacggcccagagccccgggaccccctggactgttgggcctgcgctgttcttgtaacagcccagaatctgctggtggctgccttcaatcttctcctgctggtgctggtgctagggaccatcttgctacccgctgtcaccatgctgggcttcggcttcctctgccactctcaggtgagcgtgcgccccggggtgtgcgtgtgagtgtgagtgttggtgtgtggtgatgctggcggtggggtctatgggccacaacttcaacccgcctgggctgtttccaccccgtgcacagtatcgcctggtcggcttgggcctgacgcctcttctcccacagttcctgcgctcccaggcacccccttgcaccgcgcacctgcgggaccccggtttcacggccctactggtcaccggattcctgctcctcgtgccgctgctcgtgcttgctctggccagctaccgccgcctctgcctgcgcctccgcctagccgattgcctcgtgccctacagccgagccctttatcggcgtcggcgcgccccgcagccgcggcaaatccgggcctcaccagggtcccaggccgttcccacatcaggaaaggtctgggtctaatgaccctcgagtcaagaacaaccctgacggctgccctccctcttattcggcccaaggacttgaagcccg

SEQ ID NO: 10489 - DNA, 2093 bp, Homo sapiens; identical to SEQ ID NO: 10488

SEQ ID NO: 10490 - DNA, 1063 bp, Homo sapiens
catgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactccaatgttaagtgaactcatccgtctatacctagtgggggggatgttgtgtcctagtaggcaaggaaggaccaagaaataggatgt

SEQ ID NO: 10491 - DNA, 1185 bp, Homo sapiens
ggattactgtgaggtgtgccagcagggtggggaaattattctgtgtgacacctgccctcgtgcctaccacctcgtctgccttgatcctgagcttgaccgggctccagagggcaaatggagctgccctcactgtgtgagtacctaatgccagcatctgatggccctgaggaacccacccatctctttcccccttggtttcacttaccctcttcctgcccccagatggctggacttcttagtaacagatgtccgagtgtctaggatcctaatgtattcctttctcccacaatcaacatttctgaaactggagtgtccttttccttagttcccaccagtcttctctgcacttctaggattcaggtgtcctgtctttgcctgtatcttccagtttcattccttaatttcttccatctgtctgtgtgtctatccttggccccctaggagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacagtgagtggaaacatctcccctctgtatttactgtcaggcctgatcccttcccccatccctggggcccacatgtccagcttttcatttctctgcactcccccacccttgtgggacccctatcttctcatctaacaatgggttctttctgcctctttctttcctcctccttgtacgtgtccatcccaaagtgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcaggtactaggaccttttctttccctctcccccatgacctcatttcctgccatcctctccctctcttactcctctgtttgttgggttcccatactctttgttttctctcatttcaggcctg

SEQ ID NO: 10492 - DNA, 1692 bp, Homo sapiens
tggtgggtgtgggaggcctgagaaacctgtgataggtccctgggatgggagggggactggcttgggggacattggaaacttaggctttgagttgggggcatggttgtttgtcatcagagaacatctaggagcaggtggacagaactaccgggtacaagaaaaacctgatccaactctcacctcctagctcctggggcccaacaattctgcttcctcctgtccacccgagctgggggcctgggcatcaatctggccactgctgacactgtcatcatctttgattctgactggaacccccataatgacatccaggtgggaactcgcatcctagaacccctgcaccatttagcaaggagatgtgggttcatggaggagggtgtcatgttccggggtcagaaataaatctcttctgggaggagagaaggcccttcttcagcagccttctttcctgaggcagctctatgggcagcttctccccggccactcccctgacccacccgccactttctcttgcccctgcaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggtgagaaccttttctgcagctctgtgaaagcaggcccctgctctctcaggagtacttatcagccccctggggagagaaaaacaactcttctctgcagcctttgaaggaaggagagccttcttttagtagcccttggaggaaggttggcctctttctttgcctgtagggttaaaacaaacaaaacaaaaacctttcaacattggctcccggggaaaaagccttctctagggctcctgtgaaaaggacgcagagtagaagctttcccatcagcctttctaaactttggaacccaaagttcccgtttgttttccctctcaccaggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaaggtgagaggctttgggggccagacattatctatcccaggccatctccaaaaggcagtatcctttactcagccttgaagtaggagggtctgtcccccttaaaacagtagtggacctcaaacaacttcttcgtctaataggtgagactggacttcagagagaaacgtaggcacagacagtactggtaaacacagaagggtaccttctgagacagtgcaggagaaacactgtcagagggattagaggagagatttagaaaacatgaggagagcacattgcaggtaagagatggcatggaacatgcgcaatgtccagaaaatgtatgcagagccacgaagctgcaggagtggggagaccggattgggctgacgcagcagagtagggatttccttgcagtggaaggattagcaaagaaggagacccccagtgttcattcattctgttgcccttcag

SEQ ID NO: 10493 - DNA, 1099 bp, Homo sapiens
gagggactgagtcgccagcaggtgttgacccgcattggagtcatgtctctcgtcaaaaagaaggtatcagtcttcctgtcacccaaagaatcaagctggctgcctagtctctgtccttcctctgcctctgtccctgagttgtaagcttgcgctggtgtgagacggaggagactggagcttcctgtctgtaagcgcctggagctgacacctaaccctcccaccctgccaccccaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctggtaatcagaagtcaggatggtgggagagacagaaagggagccaggagtcagggcgggagaatctctgtctttatcactgtgccttcccctgcagctactccagctccaagtgagaaaggagaaggcataaggacacctcttgagaaggaggaagctgaaaaccaggaggaaaagccagagaagaacagcagaattggggagaagatggagacagaggtgtgtggctccctggattcccctgtggagcgggaggggagggggcttggaggccaggtacctgggagccctctggctcatcctgaccccattgtcctcttccaggctgatgcccccagcccagccccatcacttggggagcggctggagccaaggaagattcctctagaggatgaggtgccaggggtgcctggagagatggagcctgaacctgggtaccgtggggacagagagaagtcaggtgggtgcatggccttaggagtgatgggggattagaatttgggatttccctcttctggggtcaggggatgagggtaacatcctcccttcctatcccctaccccctcccacagccacagagtcgacgccaggagaaaggggggaggagaagccgttggatggacaggaacacagggagaggccggagggggaaacaggggatttgggcaagagaggtaatgggtggaagggaccggacacctgggt

SEQ ID NO: 10494 - DNA, 1120 bp, Homo sapiens
gaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgtgctctgttattttttatggggggggggagtttttggggggagggataagaaaggttgttgctttctgccttttctttttaaaaaaatcctacaactttttccttttcctcatttttatctcttagattattcactaaaactgaggttcttccagccccagctatgtcatggcctctgtagagaaggagggtgagcagcagatacctacgtagcctcaggttgacttcagagagagtgggacttactggacagaaatgtagtgggaggagcgcctatcaagattcaaaactgccttccagccatccttttgatcatcctttccaccttcaag

SEQ ID NO: 10495 - DNA, 1224 bp, Homo sapiens
ccctccaaacctcaccagtaacaggagactgcagcagacccaggcccaggtggatgaggtgagtgtggggggagtcaaaagcagtaggagggaccctgggggttggcgtataggtgtaggggcccatgttggtttgggagtgatgacagttcacgcctgtgggtttgcggacaaagataccatgccccatccctgtctccctgtcagcacgcacttggaagggcgctgggggtgttaatcagctttgctagcctggggtgtgccagcctgggcaggtgtgctctggtgatggacagagcgcctgaggttccatagagggagggtgttgctatgacatctgagatgtcaccagcatgcccctgatgtgtgctccttgcatgtccccaggtgtgctaggcatgttctgtgtgtccttggcatgttaacctggcagtatcagggtgcatgttccatgtgtggcacggtgggcacatgtttgaggattgccctcactgaggtgggccttggcacacccccctgcctcgtgggcccttctcccaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaaggtaagggtggggacaggaaggaggacaggtgggtgaatggggtatcatagtttgtcttactgatcctcgcctctcacccccagatgatgatcatcttgggagtgatttgcgccatcatcctcatcatcatcataggtgagtagggtgagaatggccggggccctttccctggagaggtttccccagtggattctaggttttgaaggtcattaatctagtttttactcttcagccaaaaacacatatagctgctaatggcaattctgattcatctagagccaaaaactttgatgttatttagcctgcattttgcctagttcttggcagtcttgttaacatttggaaataggaaagctggtgtatccattgaggaccctttaggcctaagagcccagtctgagaaccctggaattgaggagtgggagaaaggaaaggaccaggggcttgagacatgaccaggaagccaaccaccccattatttgagagcttgcggtctcagaggctcagaggattagggtctgtggc

SEQ ID NO: 10496 - DNA, 1228 bp, Homo sapiens
ggcgcttgtaatcccagctactcgggtggctgaggcacgagaatcgcttgaacccgggaggcagaggttgcagcaagcccagatagcaccattatactccagcctgagcgacagagagagacctgtctcaaaaaaggaaaaaaaaaaagaaaagaaaaagcaagataattcactgggggaatttggggaaactttcctaaactggaagccaagcgtgagcccttctcattccgcctcttccattgggttcccatgacttacgtcacaggacatcgagccaatgggaactaggcatgggcgacgagcttgcccaatggggccggggcgggagatttgaaaagtccttggccagggcgcggcgtggcagattcagttgtttgcgggcggccgggagagtagcagtgccttggaccccaggtgagctggcctcctgtcgcaggccttgcgccgggagtgggcagatgatcaggtagatcagagggtccgttgggctggcctgcgcgcacgccgcagggctggaaggaggtagggacgatagcagggcgggggcggtgagaccagcgcccagattggggctagtgtgctgacctgctcccttttaccagctcgggctagcgcttccggctcgatcggtccaacccctccctctctctctctttttctctgcttctcacggctgtttcccttctccgcccagctctcctccccctttctctctaaggatggcccagaaggagaactcctacccctggccctacggccgacagacggtaaggcccttccctccgtccctgcgcccccatgaccccgcatggcgagttcctgctgggaaacttgagatcctgcaatgagcaatcctttaagcactttcttccccgttatgctccaaagtacgggtcccaagtttgacgacagaacccgctctggtcatttgtagccacatcctgtcaggtgctgccaacgtgaatctgaccagccagtgactcccagctggtgaggacctctgcagggctcgtcacatacaaatgatatctgggactgagcaggcagggcctggccttcaggccatgattcccaatccatatcctgaaaaaaaaaaaactagacagcaaatagaaatagactctaaaaggatataaagttacagtttaaaaggcccagggcaagtctaaattacaatttggaattaatgactaaattgaggtaagaatctaaatggatctaaatt

SEQ ID NO: 10497 - DNA, 1203 bp, Homo sapiens
cccagaggaaggagggtactggatgggggctgcccgagccccagggaaatgacgacaatgatcagaaggtaaactgggactccagggacccaggacctgacctgcgccctgagcctctggctaggatcccagcactttgctctccatcctcccaggttcacctcattttctttggctcttcagtccgctggtttgagttcttgcacccgggacaggtgtaccgactcatagctcctggccccgctgtgagtgtcctacttcatcatacctttccccagaaagcttttttggggttggggtctaaagagggcatgccagtgcctggtcattctctaggcctcctggaagaaggctggatttagatacaccagaaagcctgtgtgtgttgacacacttccttctccatgctccagaaagaacaaaattgggtcagaatgttttgtgaacctcccactggactagcacacactcacaggcagtcgtcttcccatttccgtgcagacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaagtaaatgtccaccaagcccctctggttaatttggccactctctcttctcccaagctagctgggtttggtgaagacttcattttctgctgcaggaggtatttcttttgttattgttgtttttgtttgtttttttttgagacggagtctcactctgttgcctaagccagagtgcaatggcctgatctcagctcactgaaacctctacttccctggttcgaaggattatcctgcatcagcctcccaaatagctgggattataggggtgcacgccaccacacccagctagtttttttgtatttttagtagagacagggtttcgtcatgttggccaggctggtcttgagttcttgaccttaagtgagcctcccacctcagcctcccaaagtgctgggatttaggggcgtgagccaccttgtgcgggttttgaatgatctgccacaaccctctttttcccataggccctgttactcttagtgtgcagtgtggcagagctcaggttttttcagga

SEQ ID NO: 10498 - DNA, 1118 bp, Homo sapiens
cgtgagggaaaaggactctggcagagtggcagtgttggggtctcttgtgtcacattgcctgtctctgcacaagccaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtccggtattctagactcctatcctattcggtgagcacagggagagatcctagagcttgaggggccagaaatgtgggttttcaaagaggaagaaaatagtggtcaactggacctcggcctgtttgcagggagcagtcactggcgtgttgaatgagcccgctggcctctatgagctggatgggcagctggggctctgccttgcctaccagcagttccgtggccttaggcgggtgatgcgacctggagtgtgtctgcaggtatgtgagatcagggctgataacaaaaagagacctctgcagcttctcttaccttcataggctccttttctgcagcagggtggttatatagaaatatagaaattaaaagtgtgtgttagggggcacttttgctaaggataacttggacagaagcttaaataaaaaggagtagagtcttgggcactgtgaggaggagttgtggccagagcatctccttcacagaagggcctttcagctggaggaggagatagctgaagcacagatctggggctggggtgatctcaggcgacccggtgagaagcctcagccatgtctgttcatccaggagccacccagcccacagcaagactgagtggagctcatgggagatgaaggctgaccgcagcgggagtgggttgtaatggaaagtgaggccagcccacgtgggagaaattgctttccgtcttcctggaacccaggcagtggcaaagtgcggttaactctgcctgggttcattgagttggggtcttcatctctgctttttcatttt

SEQ ID NO: 10499 - DNA, 1318 bp, Homo sapiens
gagccctgggcagcaccggctcgggggcacagctctggcccagtgcttctcccagcttggggaacaccctccagacctggaccttcctgagaacttggtgcgggccttcagcatcactcaggggctgctgaaaggtgagtgaagacccctggggagatagcgcacagggtgccaggcgtgcagcaggcgttcaccatctgagcagtggggcaaaagggactccaatggacgatgtaccccagatcccctgacattctgacacacactcttgatggactgactccggaaggtggggtggggctgtcaggtttgggtcccgaggttgctgagctttcttctccttcctccagaccgcctcctctgctcaggccacgatgtcagtgacggaggcctcgtcacatgcctgctggagatggcctttgctggaaattgcgggctacaggtggatgtgcctgtccccagggttgatggtaaggaacctggggtctagtctcaggcccgggctgccttctctaccctgcagaccccatttccaatatattaaagagtggagtgccctccagtcccctttccctgagtcttccctgactagcttttctgtgctgtctctctgacagctgaactggatggaactggctgacacccaccatgttcctgactgcacccctctgagacttcccatccctgagatgtccatgatgaaacatcctcagtcctgccgtcctagccctcatcctccctgatccctaccctactctctggctgcatccctctgaccctcaccctggcccttcctgcatttccctgatcccgccccaactcccttggcccttcttgcatccccctgactccccacattgctctcccagtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtgaggaagtgagggagagagcggtgtgcagtgggcagtcagagtggggtggccgcggtccatccctctcccactgtggagggggccatcctttctcctagcccgtgggagatttgttcctcttcctaggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgcccccc

SEQ ID NO: 10500 - DNA, 1178 bp, Homo sapiens
tgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggtcaggcccaaggaaggctgggggagggcccgagggttgggggcaagggtgggcatgaaggaccttggctctcacttccctcctccttccatcccaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctc

SEQ ID NO: 10501 - DNA, 1283 bp, Homo sapiens
aggccagcctgggcaagattgggagacactccccaccccgccccatttctacaagtaattaaaaatttagccgggcgtggtggcgggagcaggagccactcaagaggctgaggcaggagtatcacttgagtcctggaggtggagactgcagtgagcggtgatcgcgccactgcattacagcctgggcgacacagcgagacctgtcaatcaatcaatcaatcaatcaatcaagaggaggctggcgggagcatgctcgtgaccaccgggggcgacatagaccctaaccctaagtccaaccccaaggcagaccccaccgtcccgccaggcgcactcctaagagcgcggcttccggagcaaagccgctgacccccgcccccagggtcttggcgccgattggccaacgagagcgcagggcggagccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaaggtgagaaggccggggcgcccaggggcggctgactgggtgggttgtgggaagagaccggggtcaaccagggtctgcctcgcctcactccagcgacctccgaccggtcccggacaatcaagaagttttctgccatcccgtgacggaccagagcctgatagtggaacttctcgagctgcaggcccacgtacggggcgaagcggctgcgcggtgagggaatggcccccggctggccaatggcaggggcggggtcggaccagtgggcggggcccgcggccgacggttaatccgggcggtgagaccacgcacgggccgggagccaggcctgcaacttaaagatgctcccggggaggcgaccagagatgtcccttcctgaccccgcttccctactccaggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtgagggcccgagagtgtgtaatgtcctggaagggcggtagcggggacgcagagatccaggtaagcatcctgactctgatccccttaggtagcaaaggacg

SEQ ID NO: 10502 - DNA, 1312 bp, Homo sapiens
cctctgagctgtggcccctctgaatcccagggccacagagcagggggcccagtcacccttcctccttgtccccagaatatcctgcgccagacagaagaggggtccagccgtcaggagaatgcccagaaggccctgggtgctgtcagcaaggtgggcagtggggaagctgaagcagggggaggtgacaaggtggtagagagaaatggtagggagcagggggctggccgctggggtggtgacacagctccccttacctagatcatcgagcgttgcagcgctgaggtggggcgcatgaagcagactgaagagctgatccggctcacccaaaggctgcgcttccacaaagtcaaggtacatcgctgcccaggctccccatcttgccctgccccatgttgctgctgccacgctagaacctcctctgcctccgcttcctcgcaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagaggtgagtcctagggaaggaaggagcccaggctggagtgggcaggaggggtccagcgggacccctgctgtccttctgaacgacctcatccctgggcagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctgtgagttgtgtttccctcagaaaacaaccttgggacacttatctgacctctcagacctcccccacttccccagtctctctcttctgtggctcctgcctcagccccagaggatcttttgggccaactgtgacacttcccaatatccccaccagatcagacatgcagcgctggctgggagccttcccaaccccaggcccccttccctgctccccagacaccatctatgaggactgtggtgagtatccccctagaggggatgagggaagaaaaagcgagtcttagaggaatatgggggagaagctaaacagaatcactttaatgtcacccacccccaaccagactgttcccaggaactgtgttcagagtcgtctgcacctgccaagactgaaggacggagtctggagtccagggctgcccccaaacacctgcacaagacccctgaaggtgagaaagtctttcattta

SEQ ID NO: 10503 - DNA, 1205 bp, Homo sapiens
agagaaggggtttcaccgtgttggccagactggtctcaaactcctgacctcaggtgatccgcctgcctctgcctcccaaagtgctgggattgggggcatgaaccaccgcacccagcctgaagttactttggaaacaaatatatttgtatatgacagcttgtaaaactgtagtgagaagagcagaatcatatatttctcagtgaaaaagaaacaaatcttataatgaagcacagaagaggctttaagaattactgataccatcttgccttttctcctttgttggtaggaaattagtaaataagccaggtttgatggctaaagagtgatttctggagttttttaaaagttaaaatcttttcttattaggcatccacctaccccaggtttgggaaatggtattgaatgttgggctttcccttgtgttttagtgattatttaaagcttgggagtgtttttttcttatttttctgcaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagagcctgtgttttgtgtgtggtgatttaggacactccctagttttcagtggatcagtctcttacctctgatttgttggtctaaaatttttctgaaatcaggactgatgagattttttttatagtgggcagcagcatttgaggatatatcagaagctggaggggtgtcattgagaagaagaaggcctacaagaaaagctagttggaaacacttcctcttgaacctgtcttttaacttgcttactatggataggttgctatatggacaggctatattttttaccttactgcgtaaaagtttgtattgccattggataggaagtcttgctttcaataggataagaagcttctgtgactttatagcttctagatgacttcttcaagctgttcctccagattgagaggtctcgggttcaggttatctgatagacccatgggccccctttaccttgttttctgcacaagtgctggatgagtgccatcaaaccaaaacctaacacgtctttgagttaaaatataaactaaactgcagcttcgtcaggatgaagtgaaaaggtgtgaggt

SEQ ID NO: 10504 - DNA, 1198 bp, Homo sapiens
tgctcccacagggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaa

SEQ ID NO: 10505 - DNA, 2249 bp, Homo sapiens
tcgtaccgccacccccacaaggtcgtgtgtccgaggagggggtgcaaggggaaggttccgtggcattgagtggttgaacatattgacagccatgtgctcctgtctgtttacccacacacatctgcttcctgtgttctccaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaatctgttttctcaccttctgttctcgatttcccatctgtgatctgactggagggtgggtgctacacaccaacttcaaatgatggcgccaggccctttttgctgagggcgctgtctcccaggtcagacgacagaataattctcaggccagtcctggctccaactcttgttcctgccagtgcctcacaggatgcacacgcactaggaagggaaagaccacccaaaggcaggagctggcccacctgtcaagggagtgatttaggagggctctggtcaccagccaatgaagctcactgctgggttaggacattttcaggggtccaggacatttcaggctgcattttcaggcagacacgcattgaagatg

SEQ ID NO: 10506 - DNA, 1242 bp, Homo sapiens
attataaaacagccttatctgtggatgcacaaatacggatattttgtgagccaatattttttttttcatcctttcagaaggtgttaatcataccttgggtttctgtagtgcctttcattatagggagacgggaggtctcggagggcttttgaaatgctcaagacttaagcctaatacttgtagagcaggcccacagcattttgcctgttgtctggaagcccttgtggtctctgcaggctcagaaggcatggtgttggtctgggtggcctgggagctgtggagtttaaaatgtccgtccatggtggttggggggttgcgtcctgaagacagaccacaaactcctattgagtgccaggcattgtcctaggtgctttatatgtgctttgtttcaattaatcagattgccacaaggaacggaagcttttcaaagacagatgtcctggccatcaaagggcagcttttacacaaacgggactaagtgtggataagtctgcagggcacgtctcggcttattctgtgacactgttgcatgcagagagagcagggggtatcaggagcgtttgcttggaagactgatcacataaaagccgtgtcctattatagccaactcggagggacggttgttctgaatagtacttgaaagaagtgagctgcctgggccagtcctgtagatacagacgttcacctcaaagatatctgctctcatgaggtttgacttgcgtagcacaacttagtgagctcagtattgcattcctgtctccttactccaaaaatggatttctattgtaaactaagaagtagattttaatttgcgttttaaaagttatatcattggccgggcgcggtggctcacgcctgtaatcccagcactttgggaggttgaggcgggcagatcatgaggtcaggagatggagaccatcctggccaacatggtgaaaccccgtgtctactaaaaatacaaaaattagctgggcgtggtggcgtgtgcctgtaatcccagctacttgggaggccgaggcaggagaattgcttgaaccagggactcggaggttgtgatgagctgagattgccccactgcactctagcctggcaacagagcgaaactccgtctcaaaaaaaaaagaaaaagttacataatttatgtgaatttccccccacatcaaaaggccttggctaggtgtgtattcagccccaaatacattattttgtgccagttctcccctctgatggagagaagggact

SEQ ID NO: 10507 - DNA, 1165 bp, Homo sapiens
cgcggcggctgcgcaagttccagcagcgtgagaagaagggcaagtgcaagaaggcctagcgccgaggcagcgggcgggcgggcgggcgggcgccagggcggggccgagcgagagcgggcgccttggcccggccgccgcggacttggcccgcgagggctttcccaggtggggggagggagggggcggggccgcacggcgcggggggcgggaccctcggcggcccctccccctacccccaccctgcgcgctctgggcgggagccgcgtgcacgcggggcggggtgcgccgccggccgggccctggagaaatgacgagacgtagctacctcacggggctccttccagagcagagacgcgcttccctgggcctgggcgcggccgccgtggaggggctgggggcagcctgccctggggcccgggggcgggcgcagaatcgcacaactggggccccaggcgcggggcgtggatggcgcggagacgtggacgggaggagaactgtgaattctcaagcccgtagtgtgggcggggcgcggagcacccaccaaaccaccacccgacacgcagccgacgggatccccccctttctccccggccccttctagcagttccccgcgggccacctggctgtcacagcctggactcctccatctgaaggggcctggcagcatttggggagtggacagctcctgtccagccagcatgccccaggcggcctctgtctccactgctacctgctgagtgggtcctactgggtgggggcttggggtcggtgagtggttcacctgtggagagaggagaggaagcccctgctgctgcctgtctctgcccctgcccctgcccctgcccagcgtggggctggcccatccggaaggcagtgggcccagggacacccctgagaagcccaagccgggtggtcaccgcctcatgctggagctgcctgttggaggaggcatcgcaaacgcaaaacctcccagagagtttccttttggaaacttggaaccagccctttttatgacgttttccagggggagggggaggggcactggctgggtttacggcagtgacactatttatgtaaatgacatcagctcccgcaaggcccctcagcaatgtcaacagctggaaagggcctgaacgggcttggagtctgcaggctgcgaaggcac

SEQ ID NO: 10508 - DNA, 1272 bp, Homo sapiens
tggcttccctgaatccagcccaaggctagaagacagggcccctctccaagctgtcagcgcccctcggatgcccagtgtggtgtgctgggcgccatcagcatcacaaggcactacgctgctggggcggttgtcctatttctgtctatgccagtgtggtttcttcaccctgcccagaagggctgtggcagccccacgatatcccaccctgggtctgggtctcacgggtgtcctgtgaggggcttgcatttgtggtggtctctgaggccacctcagcaacggagctggcgacacgccaagcaacaaggcatcttgcggaaaattcagccagtgtcctgcccctcccttcggctcagcaccccgcagggcacaggctgtccgcccggtggtctggcccttggggaatgcgtcagggtgaccagatccaccatgctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccat

SEQ ID NO: 10509 - DNA, 1154 bp, Homo sapiens
tactcctggtgacttactgctgcagaataattggtttctgtttgcaaggaacattatcacagcaaagcccagaaaacagaaaggtctgtctgagagagggtttctggggctagggtggagggggaggggagggagggatgtgaaaaatcacatttctgaaaaggcaattagctaataattaattttttaatatcgttgcgtaacaggatgtgtccttatgtgatatatgtacatatgctggtttcgtagcgtatcctttgatacctcatggaaatggtaatgagactaaaccagttaaagagctctttagacagcacagtgctttggggaaggccggaatgaaatgcaggccctctgagggcttctccgacacacaagaagtccctttgtttcctgttttataaaccagaggcatgtctaaaattgcagggaaagtgagagggggttgaagagttggcgccggaggcctggctttctatatttaaaaagagaaaaaattgctagctagttattcgtgcctggatttgataggcagtctaggctgtttttgaagttctgaaggaaggttctctgaagatgtaagcgggatctgtctttcacttagacttaattaagaaacttgctggctttgtctgtagggggcccattacgcgcaagctgcagccccctctgaataggggctcagcctggaaagtgtatacaagccataccgcctttgtgttgtgttgccaaactggaggcaggagcgagtgcgaacgaggctctgccaggggccatcccttgttgttcgtaaacgtgaacccacgtcccaaacagaaagccgaagccagtgcacgggcattcctgagggacctagaactaataaaccttttagaaaatggtgatcatcaacaaaaaagtggtagggggcagaagagtgtgtatcttgttccccagagccctgttcatacatcgcaaggatggactaacaccagggtaaccagcatcctcggaggctttgtgtgtagaccgggttggggggtgggagtggttagagcctggctccaggcacaacctcactcccaacttgattccatccaggccagggcctaattttgccttggtcgctgttcttgtaaccttgagaataatttccccctggtgggctactgtgg

SEQ ID NO: 10510 - DNA, 1225 bp, Homo sapiens
tcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacatag

SEQ ID NO: 10511 - DNA, 1194 bp, Homo sapiens
accatctctggcctaagcccttcgtcctggtccaagaagccagcgatacttcttggcattgctgaatgggagaggcaggggagctgagcttgcctggaatcccccatctcccagccctggtgcttgcttcaggggcctggataaagcagctgctcattctgccacatacactcccaggggactgtgactcaggctctggatcactccctccaggaatccctccggctctgtaggacccagtttgaaaacccagtgttatgtgatgctaaatgctgacattccttccctgcctgtcagctttgctctcggaggtgcctaatggcgccagtgctgacctaatgcggccggtgttctggtttgtttctgaattgcgtgttgaggtagttggggggctttgttactctgggtggctggtctgctttattattagtcttggggaaatgatttctctgagaagcagtagaaggtgtaaattatgcttcactgcaaatcatcaagactatatatatattcagctacagctgcaagtctcttgcaaatgaggactgatgtgagatgcagccaagttggaaagggttacggtgcagacaggcagctgacatgattgataatcatgcagtcacctgtacttggctttctatggcttgtggtctggggagaagagcagcagtcatgcttagaggctatactccatctgagaaggctggagggcagcagtgagaaggtaacacctccataggagcagacacagtctccattaacctggtccttagtaaatatctcttgggtttccaccgagccagggaccccacacatggcgtcagcagcatcctctccacacctgatctccactggctccccattgcttgaagtgtcaagacactcctcatctggaccttgcacaaatatggaccctgtacaaactgcacctggcctcactccttctccagcctccttactttccctctcctggggagcgggaagcaacctgacacctctgtgcctttgctcggctgcagcttctgtctagaggcccttctcatccctgtcgagggaatgatgatcttttatcaagatccagcccatggaccccttcctctgtgtggcctttgctctcccccaggcagagtcctttcttctgctggcttgcatggggatctcctgctgggatggcaccaaccacatgggactgcg

SEQ ID NO: 10512 - DNA, 1187 bp, Homo sapiens
acaagagttgtctcaaaaaacaaaaaagaaagaaagaaaaaaacaaccacagtttcatcagcacagcaaaaaggtttttgtttttgctcttggattttgtcgtttggtttttgcttaatatcaaatatccagtcagtgtaaactcgtttataatttggtcctttgatttcaaggagctatgatgcagttcgttgtggggatgtgttgtctccatgtcatacatgtgactttgtccatgtttgcacccagttcaaggaagacacaaccctagggaaagacaaccctccccgccaagcctctcttcccattcttaaacatagggtggcgttattcaggttggaccagtttaaaaagactaacgcatttgtcctcgttgttgggtgttttttttctttaaatttgtaaaacaggaataattgtgttaggatgaagtatgatactaggagaacagggaaaactaacccatcgtgttaaaagtcagaatagtgcttaactctggcaggaggtgagatggttagtaattcagaagggggtgccaggagagcttccagagccattgaaatgttcagtagcttgatctgggtgatgatttacatacataaaaacatattaaactttgaacttaagatttatgccttttactgtttgcaccctataactccaaaagaaaagtagaggggaaaaagagtccctgcaaaaggcagtcttgaaagaaagcaagtctgtgatgtggagaatgcattggacagctctcagcaatttgctgtagcttgggcagagagataaaagctaatgccagcatcaggttgcccaggcgagagaaggcctgaaagaagacagcgtggagaaagtgtcagcaagcttcagcaacagcaggaggcagatggtaggagagtgggcctcaggtgtggtgtggcagagcagagtagccacacttaggccccagagacagtgtcttctcaccctcagttgaaggggcaggaaatcaatcgctctagtcacccctaagctggaggacggacctaaagttgccacagctttgagaggcaaagaagtttgctcagtggcttttagagacttctagggccctgggaccctgacactgaggaggagcaaactgaaggggagagtgggcacattccttgttggctgctgtggtgagcagcagctggtcgttgtcagtcaag

SEQ ID NO: 10513 - DNA, 1153 bp, Homo sapiens
ttatgaatgaggacactgtggtatgagtgtcctcatgagtgaatgagtgaagagggatgttcttgcattgaatgcctagattgcatacaattttgaaacggtgattaaaagtatgtatacagctacctataattattcatatgaaactgttaaaactcattatcattttctttatatttgcatgtgggggttaatttttactgcctaagaactttgttgcataactcccaacattattagtaaatgctcatggttaaattgccctgtctcctttaaaggatttctaagtgctgtttgttaaactttctgtgattaaagtaattcttgtgaagtataaggaaagatgataattttcatatctggtatttgtgaagtttggtaatttttagtctcgtaacggtttttctctaccatgagactaaaaattattggtgtttttgacaaaattattgtgtttttttgacatcttttgtcattcttttccagagaattcggtcaacagtggatgaaaaagaacaaaaacaacttcttatggatttggatgtagtaatgcggagtagtgattgcccatacattgttcagttttatggtgcactcttcagagaggtaggaataaactgggttttagctgactaatgaatatctaattgggacaaatgaagatggcaggattcgattctattcttaaatgccatacattagtaataagttaatatctcagtatcttagtgtttaaccatggtaatttacatattaacttctgactctttttgcggtggtgggtaaggggtgaatcacacgtgtgtttgtgtgtgtgtgtgtgtgtgtgtgtgtgtgtgtattttagtattggtggctgtcatttgtaaatctcatacaaatattttctgttctttaagaacctgaaaaatcagctgacttctaaatatcagcacttttgctatagttttagattttcattgggccttgagcaacgcctcccccccccccccccccccccgccgccaactttatattttaacttttactcatctgtcatcaagtgtatgtctgcatttaatataaacacttatgtgtccctgcccataatcctgaagtatacccatcagacatggaaattaacaattacaatataaattatttttttctaatt

SEQ ID NO: 10514 - DNA, 3104 bp, Homo sapiens
tgcatggaataaaggctgtactcgcctctctgaacttgtagtgttgcggtatttcatagctatgtgtggttgggagcctggagttctatgttctatagaaattggaaaatgttcagtttgggctgtcatacaaacttttgacttttttgttttcaattttcttgcagaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactttgtaatttgattttctgaaatcagaccctgagaggggaaaatcttaaagtaaattacattaaattatctgtgcatttcacaccagggaaaatgacctccttttggaagtgttttatggctgctttctttttcttcttccttcccatggctaccctttttgcttatccttcttgaaaccacagatgtatctgttaagcatagctttgcttgaacaggtgtcacagtctcttgagtttctttgtttgttgtcctgacctgccccagcattcttaatgctaaaggaagtgggtacagttcttcaacctgtgtcatggtggagaggtacaacttataagtctatctgggc

SEQ ID NO: 10515 - DNA, 1139 bp, Homo sapiens
ttgctgctgtgcagctcttggaattcagctgcagaggcctaggcattagccagtggtggggagcctgggaactggaggctgaggctgcagcagcctctaggagcactggtgctgcagacatttttgtctgggccaaagctgccaaagtcagtgaggatcttttccttgaaggtatctctgagacattgccctgccttgtagtaggccttctaagagccgtgacccaatcaataggacattagaggaaaatcagaaccaattccaaatttggctttggactgctttgttccttcccttctatttcccttactgtgagttagacctgccagaccaacacaggccctgccatgggcttcctgttagcccagcagggctgggcggacccaaactcgtcccccaaagagcgctgtgcacattgaatgggtctcagagcaaagtttttcattagagttttatggaagcccaggccttactgcctgttctgctgtatatatgtgagagataacagagtgtactaacccaccgattactgggttagcaaatctggagagaatattctttgctcttatcttctaagatcctcactgtgtgggtctgctgggtttcaccttctgctgagctgctgtcagcagtcagcctgaagctgtctagatttcctgcagaattctgttatcccagacctgcaagtcatcgtgaggaagccatgctcttaaatagcaattaatcattttccttcccagtttgtctccatcaaagtaatttatcaatgattttttttttttaatgatgggcaataaggaccattttttttttctctagagaaagtggatcagtagccatacaaatatactggtaatttatggtcattccttttagaggggattagtaagtatcccttttattaataatcaaaagcagtttatttcaaatgctatttgataaagacagcaaataataaaattatgctacatctgtgtggatgtagttgtaggtcaggcaggaggttggggggagagtcagagagtcaggcctcttccctcgggcgtggggcatccaattgagctggcacctggaactccaccgcctttgggaagcttgtggctgtctagcaatttcaaactcttctttctgtccaggaa

SEQ ID NO: 10516 - DNA, 1302 bp, Homo sapiens
atatgaacccgttatgccaaaaagaaacagtgtcttggctgagcgcggtggctcatgcctgtaatcccagcactttggaaggctgaggcgggcggatcaccttaggttgggagctcgagaccagtctgaccaacatggagaaacctcgtctctactaaaaatacaaaattagccaggcgtggtggcgcatgcctgtaatctcagctacttgggaggccgaggccgcagaatcgcttgaacccaggaggcggaggttgcggtgagccgagatcatgccattgtactccagcctgggcaacaagagcaaaactctgtctcaaaaaaaaaaaaaaaaaaaaaaaagaagcagtgtctctatgtccacacatgtctgtatatgtatatagatatatatagaaaggacaggaaggggaggctttaggattactttaggtgttcagcagtagaagaccaccttgcacactgggtgggtaaaagaaatctgctcagcattgttctttcatatttcacctcgagctttataaaccctgccagaggaagatctctggggccaggagttcaagaccaacctgggcaacatagtgagacccccatctctaaagataataaataaataaacaaacaaacaaataaaccctacaatggacctttgcaaagagaaattagtcctttgttgtgtaagttgcaaatattttcttccagtctattgtttgtcatttattataataccatttatcttgtagcaatgtaagaaaattgtgtcaggaagtctttctttttttcattacaatttctaaatttggagtcctgcttgggaaggcctttctcaccataagattctacattatcttcattttcttcccctgatgtttttttcagcattttatttttttttacaactaatttaattcatttcctatttatttttctgggtgggtggtcagagtaatggaacatatccaaatggatatccaattgccccaaaactatttattgaataaccaatggacccagttatatttattcccaattcccatacttctttggactgtttattaaaatttgtctaaaattgagtgtctgtctacagaagtccaattaagtgagcgattaatgttgaagatttgagaaacacttgtgtgatgaagtgtctagcagagctctggcactaaatggaagatgttattgtaacacagaaacaaaaataacagagacagtgtggatataaggctttgaaatgcgttgggcagggtgtctggataaaaaagtcatgcttgtggtcgagctccaggtaaggccctg

SEQ ID NO: 10517 - DNA, 1279 bp, Homo sapiens
tgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctgagcttggcatctgttcttgctttaataaacctgcggggacatggccgtcaatctcaaatgcacaccgggatggagcctgaaggtcaccacctgtgtaaagccaggtccctggctgatctctcgcttgcttgtcttttgagtttttaaagctcttctttttacattctcctgggtagggaatatacacaataaatactagattcaacttacttacttacttacttactttacttacttacttccttggaaaatgctctccatttgtcgagcactaatccacgtctgtaaatcccgcaaggaggacaatggaaaccagccccgtgtgccatttctcaaaaccttcgagggcaaagtgatcctcactcctctcagtatggaagcaacaacacagcaaatctattgtctccacttttacccagaaccaccagaagacttgcatttccctgaccaatgaca

SEQ ID NO: 10518 - DNA, 1155 bp, Homo sapiens
ggaccacaaagctggagcctggaggaggcactgccacgttgagttggccctttggctgcgtcttttcctccgcttccaaacttgcccagagcttttgttactcatctctggctaggaaatggttttttgcaaaactcaacatagtccttctgcgccacaagaatgtcttctcttcctgttcagttcctttcctgcagcaggacaggtttgagtttacccagccttccttgagtcttgaatctcacacggcctgctcagcggaagctttgaccggatgcaggaggtgtggctatgagaccctcaccttggtctcctggggtgccgggccctgggccgttgccctcttcccagcacgggtcgtgtcgctttctgcctgtgacatttcagggccatggcgcagggggctcggcctgtgccacccccactgcggctgtgttagaggctggtgggtgacgtcgggctggcaactcctgcaagagagagggctgcagaccctaacccggaggggatggccctggggcctggctgacgcatgtctcctgtttccttgccagggcttgccaagtatcttgctgcagagagaacgcgccttggtaagtgtggcacttgatgggcgttctgagtttcagcggtttacacatcatccgccatgcctcttggcactccagtttttattgagatgttctgtcgtcgagtcggcacttgcattttttgttccaggcatctttgggaaagccgcttcaccctttgctggtggttgcccccaaccagctcaaagcctggctccagcagtaccacaaccagtgccaggaggtcctgcaccacatcaggtgagcatccagggcagcctggcccgctgggctgttgcttgctgccgtctccttcagaagctcaaggtggacactggggtagttaccaatatcccccagcagccttgcccttgacatggtcccagatggcagaagcaggggagaagtgcattggctgaaggacagaaaccattagatagttcccatgtaatgcttattttcttagaagcatttcttcccagtcctcatttgagttctgagctgctttctaaacttcgagcagcttttcttgatgagacagttccagagccaagcacccaaatagtggctagcacagagaatgtcc

SEQ ID NO: 10519 - DNA, 1206 bp, Homo sapiens
atgttttatccatttcgtagcttttttactgtctccagaaagtagtgtgggacctgcacttaggggaataccagaatcatagcgtggttctgccttcttgatgagtgattgtgaaaaacacctgcataagggtgctaattggttgtgtattttttcatttatttgaaatcaaactgagaacacctcttttcggtttacagcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgcca

SEQ ID NO: 10520 - DNA, 1171 bp, Homo sapiens
gactaaccatttttattggtgaaaaaatagaagttcaggggtaaaacaatttgaggttatgcaaatatttaaaatcaatcagatctgtttgactctgtctcttgctccttaccattctttcgttgtttaattgatagactttctaggatgtcgttctgttcccccactttgaattggattttattcctactgaatacaaggggtgcaaaatagggaggacttcaaaatctggttccaatgccttcccattttttgaagaatcaagctattgcatgtgactgcctctaaatggcctgcatttctctttgttggtaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacactt

SEQ ID NO: 10521 - DNA, 1171 bp, Homo sapiens; identical to SEQ ID NO: 10520

SEQ ID NO: 10522 - DNA, 1804 bp, Homo sapiens
tatccatggatttacttcattagcgcatgtctacttttttatttatttattttttttgagacagagtctcactctgtttgcccaggctggagtgcagtggcgcgatctcggctcactgcaaactccacctcccgggttcatactattcttctgcctcagcctcccgagtagctgggattgcaggcgcccgccaccacgcctggctaattttttgtatttttagtagagacggggtttcactgtgttagccaggagggtctcgatctcctgacctcatgatccaccctcctcggcctcccaaagtgctgggattacaggtgtaagccacggcgcccagcctagcatgtctactttttaatgtgattgggccattgtatgtaaggtaatgctctgcttagaaatatagaatgttttcctaggcctaggccccaagtccatggtgtgtgaagtgaaataactttgatgttaaggagttctttttttgtcttttgcggaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagttaatgaaagtgttcatttacacagataatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgtacttcatggggaaatttcttagacgtatgcaagcaagtgaaaacaattagggccagtggtattaactactttataaaattttatttttgtttgtaagaagttatctacttaaggcccagttaatataagtggaatcatcatagtttaaggaatacccagagattgctgctattctatttattttacagaaaggatagctagattgaaagttcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggcatttgacatgtgtaatctcatgtaaccctcatgataaatatgtaatactttagatgatataactgaacttcaggttaatgagtgactttcccaaggaaaacagattgcaggaatatctgtaggatataaaacatgat

SEQ ID NO: 10523 - DNA, 1148 bp, Homo sapiens
gtttcactgtttgatgcggaagaggagacgactaatagaccaagaaaagccaaaatcaggtaggaggagaagttgcatgagctgtgttagtgtccagtgttgttctgtatgtatgtcagtgctagctgatgggagtcaaggcagagttgtttcaatgtgcttgtgaatactgcatgttgctaatttaacatttagtgtaagacaaagatgacatttcagattttcttgtgaataattggcatacttaatactgagttttaaaatcagcaaatccaattatttgaacacctgtgtttttaattctgtgctattttccaagaatgtaccatttctttatatagtttctgtagatactttacattttgatttattgtgcacatttcaaaatcacataacatttctattctaaatttaattctctctaaataaattcacttatcgaaagcaaattctacttgaaccctgctaaaatgctgttttttacttttctttcatctttcatgccagtcacaaaagaccacatattgtatgatttcatttatatgaaatgtccagaataggcaaatctgtagagacagaagatagattagctgttgctagaagctgaggggtttgaaggtaaatggggaatgactgccagtgggtgcaaagattctgtctggggtaatgaaaagttgtaaaattggagtgatggttgtacaaatctgtgaatgtactaaaaaccattagattgtttaccttaaataagtaaattgtatgatatgtgaattatatctcaaaaaagctattaaaaaacaagaaacaggctgggcgcgatggctcacgcctgtaatcccagcactttgggaggccgaggcaggtggatcacgaggtcaggagattgagatcatcctggctaacatggtgaaaccccatctctactaaaaatacaaaaaattagccgggcgtggtggcaggcgcctgtagtcccagctacttgggaggctgaggcaggacaatggcgtgaacccaggaggtgaagtttgcagtgagccgagattgcgccaccaaactccagcctgggcgacggagcgagactccgtctcaaaaaaaaaaaaaaaaaaagaaacaaacaaactacctgataactttgtcttaatgtctgagtg

SEQ ID NO: 10524 - DNA, 1148 bp, Homo sapiens; identical to SEQ ID NO: 10523

SEQ ID NO: 10525 - DNA, 1197 bp, Homo sapiens
tttcaaaaaacaaaaaccaaaccaaccaaataaaaaacaaagaaggcattcagaggtagaacgttctgagaataacagagctggggtagagggggaggctgggagccagaagcgttaaatcttctgtcactaaggggaatgactgggaggctgtagaagacagccaggaggagaggaggcgtggtattttggggcacataaggggagcagggtttgcaaaggggctggggaggggcgatggtctagatgttgtgatgggggctgaggaggactcccatccacctaggcataggaaatgagagaaggagctacacgggttgagaggtggcaggagaaattgtctttgggggacattcaagttttggttaagacaaggagcaaagcagaatccgaggagagacagagtatcaagatgccccagggctcagtgggagcaaagtggggtggtgactgtagagcctttgaagcaatagggaatttgagttcaaaagaatcatgtgactttctagcctcaatatttgggtgctgggggtttgagcatgggcatttgagacttgatgggatgtgtcactgtccctggaagcaggatcagagcttgggcctagtggtgttctgctttgagggttggcattagaggggacttagaagttgtggtgaattttgtggtcccagagggctgaagatgagcctccagaggggccaccactcctaatcccatgcccctgccaaatatcccaacctgagcatgatgccgtctcccattgagctcggacatgcacttagaccccaccgcaacataattcctcagagggccaaactagaaattgatttaccggccctgacttaggacaacatactcatttcatggacaaggaaactaaggttaagtggggacacgcgttgggcgcggtggctcacacctgtactcccagcactttgggaggccgaggcgggcagatcacgaggtcaggagattgagaccatcctggctaacacggtgaaaccccgtctctactaaaaatacaaaaaattaaccaggcatggtggtgggtgcgtgtagtcccagctactcgggaggctgaggcaggagaatggcatgaacccgggaggcagagcttgcagtgagccgagatcatgccactgaactccagcctgggcgacagagcgatactccgtctcaaaaaaaaaaaaagagag

SEQ ID NO: 10526 - DNA, 1231 bp, Homo sapiens
atacaagttctttgtgctatttgcaacacttcttatgtctaaaattatctcaaagtaaagctactatgcggaaaataatctaagatttaagaaataagagaattaagtgctgccgggcaccggggaggcaggttggtgtacgctgtgcgcggcggacgtcagaggcagcggggagcggagcggggccgccggggcctctccagggccgcagcggcagcagttgggcccccgccccggccggcggaccgaagaacgcaggaagggggccggggggacccgcccccggccggccgcagccatgaactccaacgtggagaaactgcccccgcacatcatccgcctggtgtacaaggaggtgacgacactgaccgcagacccacccgatggcatcaaggtctttcccaacgaggaggacctcaccgacctccaggtcaccatcgagggccctgaagggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaggtgcctgctgatccaccctaaccccgagtctgcactcaacgaggaggcgggccgcctgctcttggagaactccgaggagtatgcggctcgggcccgtctgctcacagagatccacgggggcgccggcgggcccagcggcagggccgaagccgggcgggccctggccagtggcactgcagcttcctccaccgaccctggggccccagggggcctgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaataataataataataagagaattattcccttaagataaaataatatgtaaaaatcactaagtagcccctaagtagaaaagacattatgaggaaaaatgaa

SEQ ID NO: 10527 - DNA, 3074 bp, Homo sapiens
aatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatccttacacgtgatttttttagcacccagaactaaattaaggtcttcctaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatcaccatacgttaatactggtttctactgaaacagtctgatttatattgtatcttatctctctgagctagacttggtaa

SEQ ID NO: 10528 - DNA, 1140 bp, Homo sapiens
cccctctgccataatatagtgtaactagaacctatgttgactcacctgataaaacttcttgggtgtcagtttagtactgaagtcctttatctttaacttgacgatgaaagaactggtcagtcgactcaaaataggtaggaaaacccttgaggtttcacctggactaaggagccaagggtgagatggtgtctgatgttgaaggacatgcggagcctcaaggacgcagcttctgccactgctgctgcccgggcagcactgtctgatgacgtgactcctggatccacggggcgcgcatgggtcaagtggcagtaacacagtggttttttttgttgttgtttgtttgttttaactatgtatatagtgaatacctgaggcaactttttttctgatagaaattggcagcttttgctccttctcctgaatgaagtcatgagttaacaagtttctgtttaggtaagtcccaggttagcctttgaaacacaatctaatatttcacatattacaatagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggtaagtgtgcttcctagtgacagcaaccattcatggcgtgggtgctcatgctttaacatttccttcagttgttgccgtttttctcagaactttgggcttttatgtctggatggcattcttagaggatcatttgtctcttttcctactcatctaatgctagtgtattttagcaaaaagaaaatatttataatatcatatttaaataggttagaaaatatttgttcattattcttgaaattaaatctttctagattttttttttaatgtttttgtctaggggaaagggtcatccattgattcagccaacatttgaatgcttactgtataccaagcactgtggactctgaatagatttaatcttacctatttctaaccgtgaccccaaccctattaattattaaattatccccatttgactagatgcctttgagttggctcctttccagtcagtctccatacctccacctgagtgatttgtctaaaactca

SEQ ID NO: 10529 - DNA, 1190 bp, Homo sapiens
ggtttctccatgttggtcaggctggtttcgaactcctgacctcaggtgatctgcccacctcagcctcccaaagcgctgggattacaggtgtgaaccaccatgcctggccttgtgtacttcttatcatcaggttttcttatgtctatagcatagagtgtggaatgtgggaaagtatgcagcttgggatcagtggggttgtgattgagatttgtaaacagaccaaaaaagatcaccacagtgaactgtaactgccatgggccagacatagacctgagatagaaaagtagccagatgactttgctacctgtaatgtttgtttctttccctttagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatggtatgttacttttgttgcttggtctgatactttttattgcatttaaaaaaaaaaaaaaaaacctttgtcaagtagtaaatatcaaattgtcagctttagagtatcccaagatctacaggtcttgcttgagtctaggagtatggaaggctactaatttaaaagtaggcataatttaagtaaaatacctgatatttaaatcaagtgcagattatgatgcagtccagaaatgctatagagtaagtatatttttagagtggattttcagccaattgcataaggttttctggaagtcagttttgacattgttccttcagcggcagtgtggtgtgaaagctgtaagtagcctctggaacaagactgcataagcttgaattaacattcttactgcatcaactcagatgagttacttagtttttttgtagcttagtttcctgatctgtaaaatcataatgtaacattaagacctacctctctggattgttatgaagatcaaataag

SEQ ID NO: 10530 - DNA, 1246 bp, Homo sapiens
tctgtaggaaactttagccttctcaatggctgtaaatacttcaatgaggtcatcaaaggagtagaattcatcctaaacaactactttcaaacatggtttctatcaccacctgaaacatgttcattatcagatttttatgctgtatcattatctttaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagaggtgaggctcgttccataagtcctccccgtgcttactctgctggttggtgactgaatcacagggtggtgctggctgcagacatgtctcctatgtaaatattggcacgttataggtagtctgtacaattttaatattgggctgatactgttctgtttaaataaccacaaactattgtatgatcattttaatgaaacagattatacatttctcctatatctgtcttgttacgtgtattctgtatgatagcataacagggaatttcaactaataaagttgtgaataaaccacagataactgttgtgcctgaggagggcagcagtgggatgtggtagaagaaggtggaggctagaggcattgaggcactcccgcttctctaaggcagtgcaacctcaaaacaaggcctaccagcccctacttattaggtagaagaaaatgctgaaaagagagacatgttcagtgttctgaaaatttttagaaagcataatttaaatgcaaagtaatgataattatgaccacttttttgtatcagtta

SEQ ID NO: 10531 - DNA, 1193 bp, Homo sapiens
tttgatgcctgtttgcttatttttctatttattgttctgtaatatgacggtaaaagttgttctataaaatgatgttgagactttaaaaaatgagactaatatgataattaaatgctccataaggtcaccacttcagtgaacttgacattactttttatcttccaggtctaaaattttattatgttaagtatcagcttagtttaagaaaagaattcttctcaaaggagtagattatttaaaaaacgatatggatattctctgcctctgtaattcatacagtgaatatttattagatatatgagtaattattgtatgttagatgctgtggtatacactgctattgttattaaactgcatacatggttttttagtgcacattaagagcattggtccatggccctccttaaatttctagtttatgttttattctaagtaaattgtattttttttccagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtaatttatattttaaattattctctaatagacatctacataagttagtaaaaagtatttggcatttacttgtaaattgaactgttttcacaaaaacttggtcccattttggtgtttgaatcaatactgtgaaaagtagagaatattgatcttcctgtaagtttataggtgggaaaagaggtaacagataagaactggggttatggagtcatgttaagagtggttcccaaacttgggtgctggctgaacttttggggagcttttataaagtacagatttctatgtattaccgtagactaatcatttcctggtgtatggtgcccagaaatctgtgccctttaaaagtctccagtgattctacaattgttcctcagattggcagttagaaagccctatacatagtatttctcttctgttttttttgagacggagtctcgctctgtcgcttaagctggagtccagtgttgtgatctcggctcactgcaacctctgcctcctgggttcaagcgattctcctgcctcagcttcctgagtaggtgggactgcaggcatgtgccacc

SEQ ID NO: 10532 - DNA, 1148 bp, Homo sapiens
aaacataaaaacactcacctagttttgatgggaaaaactactactcttaactagcaggttgattctctgtacttcagtttcttcattgtaagtgtggatggatttgattagacttccattacccttcttccagcttactcattatgaatttagtattggaatgctttttaggatttcatattgaacacatgagtttgagattttactgatgtgagtaatacagattgggagttattgtaatttgttattagaggaatgagtcaatatagattaaacttgaaatttcattttggatttttttaatgatatatagttaaaatgttgattattttaaggggaagaattagatcaatgaaggattgaaatagtcattgctctttctttccatacttagtggcccataactacctttatacttgctttgatttcatgatgttgttcagtttttggttaataattgatttatgattattttaatactaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggtaatgaggtttcttttatgtttctatctaggattataattgtgaagtatacaagtttgtcattattttatttttttactttttattaaccaagccatgactggtcatttatagtttgcattttgagttcttttttgttggttggttgcaatagttaacaagctcttaaaacttgtttccatagtttggcattaatattatttagtagaaaggcagtaaaccacctggtcacctgtgtgtccttggttatgttctatagacttgggctgcacattagaaccccttgggatgcccaagcctcatcacaaaacacttaaatcaatctctggagttgggcccaggctttattttatcgccgaagtttttccggtaattctgatttgcagctagggttgccagtcactgatctcaactcttcaagctttagttttccctcctataaaaatggagataatagtggcattgtcctcaactgatagtaaatattctgtcagataatgtaggtcctgtacatgcatggtgggttctctt

SEQ ID NO: 10533 - DNA, 1243 bp, Homo sapiens
ggctcagggagtgtgattcccatctggcagttgaggaaagtgagtcagagggctgaagcggtaggctggagccagtgctttccgagccagctggcagcctgtgggtctcatcactgaagccataagctgtggcatatcctttggaagccctaatgtgtagcgtgatgatgcctgcaggtgggggcttatccaggagccggtacaccatctggtctcacccatactgaggatccccctttgtctgtgccactttctcgtaggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcatttcttttgtactgtgatttgcttctgaggccagtcgattaatagcagatatatactcagcactatcaagatgtttgccaccaggcattgtggcttaagcctgtagttccagctactccggagggttgatcgagcccaggaggttgtggctgcagtgagctgtgttcgtgctactgcactccagcctgggtggcagaatgagactgtctcaaaaaaaaaataagaaaaaagaaaaaaatgtgtagctaaattggaaagaagacataagataaacaattattaaaaatggaagattgtggcagggcatggtggctcacacctgtaatcccagcactttgggaggctgaggcgggtggattacttgaggtcaggagttcaagaccagcctggccaatgtgttgagaccccgtctctactaaaattacaaaaattagctgggcatggtggcatgtgcctgtagtcccagctacttgtgaagctgaggcaggagaatcacttgaacccaggaggcagaggttgcagtgagtggagattgcaccactgcactccagcctgggt

SEQ ID NO: 10534 - DNA, 1216 bp, Homo sapiens
agagtgctcgaaagcaacccacggtgtggcagttcctcaagaggttacaggcctttccgctcggctgttttcctgctcaggagccgcagggccgtaggcagccatgacgcccagccggaatggcatggtcttgaagccccacttccacaaggactggcagcggcgcgtggccacgtggttcaaccagccggcccggaagatccgcagacgtaaggcccggcaagccaaggcgcgccgcatcgccccgcgccccgcgtcggggcccatccggcccatcgtgtgctgccccacggttcggtaccacacgaaggtgcgcgccggccgcggcttcaatctggaggagctcagggtggccggcattcacaagaaggtggcccggaccatcggcatttctgtggatccgaggaggcggaacaagtccacggagtccctgcaggcgaacgtgcagcggctgaaggagtaccgctccaaactcatcctcttccccaggaagccctcggcccccaagaagggagacagttctgctgaagaactgaaactggccacccagctgaccggaccggtcatgcccatccggaatgtctataagaaggagaaagctcgagtgatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaataaaaaaaaaaaaaaaaaaaaaaaaaaaaggaggttacatacagctttccatctggcccaacaaccctacttctgggtacatgcccagaagaattaaagacaggtattcaaaccaaaacttgcacacagatgtccatagcagcattaatcacattcactaaaaggtggaaataacccaatgtccatcaaaagacgaagggataaacacaatggtgtgtatctaggcaacggaacattaatcaaaaaaaggaagttctggtacatgctacaacatgggcaccatatggatggatctgggaaacacaatgcatggtgaaaaaagtcggtagattccattgatagaaaatgtccaggaaaaggggccgggcacggtggctcacacgtgtaatcccagcactttgggaggctgaggcgggtggatcacttgaggtcaggagtttgagaccagcctgacct

SEQ ID NO: 10535 - DNA, 1138 bp, Homo sapiens
ggggtttcaccgtgttagccaggatggtctcgatctcctgacctcatgatccgcctgcctcggcctcccaaagtgctcggattacaggagtgagccactccacccaggcttttttttaagacaagagttttactcttgtccccaggctggagtgcaatggcgcaatcttggctcactgcaacctccgcctcccaggttcaagcaattctcatgcctcagcctcccgagtagctggaattacaggcgcatgctaccatgtcaagttaatttttatatttttagtagagacggggtttcaacatgtttgccaggctggtctcaaactcctgacttcaagtgatccacccaccttggcctcccaaagtgctaggattacaggcgtgaggcatcgcacccggccacccaccctttttttctcccaagaaaaccagttttctgaaattttcagggggaaccaggacctcctcgcccatgtctttcacccctgggtgcctgtatcctgtattcaccaaagccccacgggcatctccccgattgaggtcccacccctcagggcctaggacagggggaccagggagggcccccagaggctggagtttggaatacccccttctcttctctggagctcagtttgcatgtctgtgaaatgacaggtgatgtcacctcccagaagggcagtttgagagaagtaaaatctattgaggcaccttggacacaggagggggtcagacggcatcagcctttgagggtgctgcagttacacggctccagcagtctgagccttatcaagacctttccagatatgagggaagtccatgcccagtgtctagctggctgggggagaagccccttgagaacccccactctgtaatgctaggctctgcatttgcttaggaggctgtgtccctgtctctccccttctgggccagccttgctttctgggcaggcccaggagtgtcccgggcccagcactcagagtcagcgctgtctttaatctgtattccacaggcatcctcaccccctcccctcccaggagctaggaacctgccaggcttcttacctctctgctggaatctccaccccccaccagaggctgccctcttggggaaggggcccagcccttgaggcctgtctcctc

SEQ ID NO: 10536 - DNA, 1365 bp, Homo sapiens
gggggagagcaggagccgcctctcgcagccactctgcgcgcggggtgggagggagagagggaggcgaagggacgacagcgccgggctccccgcccccatcccacccggttccaatatttcgcagaaaggcacgcggctcctaatcggtcttttccaggctgagatttagccgtgcgatgcccgcgcaggggcgggggccgcgggccaggggaggcgctcagagtccggagccgccgagcgaggtgaggagcccgcgtcctcggctggtggagcgggcgggcgggcgcgcaaacccgagaggcagatatagaaaggggggcaggttaaaaataaccctctccggctgggaagctcgcgcgcgctctctcgcctcgttcggtgccagaggactccaggggaggtggcgttggggagggcagagcgggattccccctcctccgccgggcggggtgcccgcctgcgcgccgcggttgcacgtgtgcggggccgcgcgcccgggccccctctgcacccggtcggtgggtgccccctccccaggaccgggcgcatctggcagtggccccccgcccgcagccttgcgcggctggagggaagcgctccattattcattatttacgagcgttaataggtttgagccacgggggcggggggttgggggggcgacgaggacccagtggggaccgaagcattagaagaagggatagggagggagggggaagggcgggggcggggctgtgccgcggcctggaggaagaggtctcggcctggggcccggcgagccgggcgcacctctccgtcaggtttctccacaccgccggccgtcgaggctgctcagggcgccaagagggcagcacgggccttagattttgctctcggcctctgtccttcgcgtcctcgcccttaccgaggcgtggggagggagctgcggaggccgtacgccccgccctgcgcgccccttgccgccgccgcgtccccgcggcagccccggcctcatttatcatcatctttggtcaagtggagtgtgcaaggaacagctgcttcactcggctgacttcgagggcggctacgggagaatcagggagatgaatgatgggggctggtggcagccccccgcggtccccgcgcaggcgagagggaggcggggacgtccagggccgcctccgcctcatggcgagtgcagcgcccccttcctctctcctggcgcctgcagcgaccggggaccgggggaccggggcaccgaggaccgggcccgccccgggaggggactgggcgcggggacgggggggcgcccttcgccggcggagaactggcgggcgcgctgccggcagagcccgaggttgccgtgaccttgctggggtcagcggg

SEQ ID NO: 10537 - DNA, 1123 bp, Homo sapiens
gacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccagga

SEQ ID NO: 10538 - DNA, 1339 bp, Homo sapiens
agggctcccgcgggggcgtggccagcttgagacccatccctgacacatcctcgtgtgcgcaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgggttttgtgtcttcagctgatggatgtgctgactagtgagagtgcttgggccctcccccagcacctagggaaaggcttcccctccccctccggccacaaggtacacaacttttaacttagctcttcccgatgtttgtttgttagtgggaggagtggggagggctggctgtatggcctccagcctacctgttccccctgctcccagggcacatggttgggctgtgtcaacccttagggcctccatggggtcagttgtcccttctcacctcccagctctgtccccatcaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtga

SEQ ID NO: 10539 - DNA, 1200 bp, Homo sapiens
gagtgtggtcccccagcagctactgacagtcacagctgcccccacggcagcccctgtaacgaccactgtgacctcgcagatccagcaggtcccggtgagggggtctggccaggggttggggagggggcagccccagcccagacacacagcttacagccaagcctctcccaccctcaggtcctgctgcagccccacttcatcaaggcagactcgctgcttctgacagccatgaagacagacggagccactgtgaaggcggcaggtctcagtcccctggtctctggcaccactgtgcagacagggcctttgccggtgggtgacgtgggcagggcataagggagtggggtctacacacacacacacatgcccacctggtaacatgtgcctggccctgcagaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaaggtgtggagaggcctgcaggggcacagaccggggtgtccctaggaaggaacagatcaggggcaactggaaggaagagagggagtgagactgagcctggacaagcagggaattggaattcagcctccccaggcctggccagcctcgtttatttagttaaactggtttgcaggcctcttcaataaaggtggggctgtgctaggcattggggatgcagcaatgaacaagacagacaaaaattgtccctcaaagaagagccgaccttctggtgggggagatggacagtaggcaggatgaataagtgctcgagaccaccacgtttggctcgttgcagagaaagcaggaagaggatggtgagggtcccctggtggtagccagggaaggcctccctgagatggcggcaggcacagcagcagctagccagaccctgctgtctgcatcttacattctaaccctatgcccggcctgggaggtgggtgctactaggcgaggaacggttcaggtagaaggaacaagtgcaaaggtcctgaggcagtaatgttgcaaagcagctccgcacccccttgctagggctctccaacccc

SEQ ID NO: 10540 - DNA, 1138 bp, Homo sapiens
cacgggcaggcagggcatctgtgtcctcgggcctcctcccgggcactggtgccacctcacgggcgcgccagtgccactctgccaggaggcacccctgaggcccaacttggactcggagatgccccaggcttccctgcccatcaaggctcagcccttccttttgctgctagaggtggtgccaactgctggtctgcttccccaatgcgctttgggagatgccactgcatgtgtctttatccagcccagcaggctcactgccactgccccaaggacccagttctcccaaaccctttgtgggatgtcaccttcttctccatctttgtccctcctcttcggtaccagcaaccctcagactgggcaccctcccagaaatgccccctgctccgggacttgctaatttgagctgcaactcagctgtgctgtaggagggactgggataggaggaggggctcttggagggtgattatcttggcagggggatggcatgcctgcagtgcctcccaggaaagaagggaggctgtgttatttaatgataagagccctggactgggaatcatggaagcctggactctagcagtggttttgtcagtgactccatatgaccttgtgccctttctggtttgaagttcccctgtctgtcaaagtgtttggagatgagatgtgatagatcccttaaagttctcaagttttgatattctttgtagtactctgcacattgactgttgcttcctcccccacctcatattaagtttaccaaagctgaaatcttttgttggcaatgtagagagaatggtactcagcattatctgttaatcctataggggggatgtggacacctggggacaccagagatggccagaatcatggataaggaaagcccaaagtgtaggtaaaggaatactgaaatggccaccatatgggacttccttactaagaaagcaacttgcctttttacccaaggcagtggcttatgccacttgatcagtcaagaatgctgattagtttgtttgaaaactggattcctcctggttggttgaaggactggtaaaacgtcttttatgagccaggatctttggtgttcttatgggcctgatttcagcagtagtgatttgtttattttctgctttgcttatgaaat

SEQ ID NO: 10541 - DNA, 1265 bp, Homo sapiens
ggaaaaataaaaaagtattctaccccagaatccaccctggaaccttggagaattggtgtaaaagggacaaatgactgagccagttggagaaccagtggcttgagggagccttagtggtagacacagtgattttggagcctctttgggtctaaccttggaaagtaaaatctaccaagttatgatctgctttgtatgctagaatattaaaaatttatttgtggaaacatccaaattattttctaagagactagcatgtaacaattgaagtcaaagaagggctgtctgctgctggcaaaatccaggaaacccttcattctctgggtgatttagattcaggtccattgccacagcctgttggcaaactggctgcgatctaactctggtttggattgtcaggtagcagtgtctaggtactggaaagaagttaaagcaaagtttatttttcctttgtacaaaggttaaaaactctcactcaacatcttattttgatatttgggtttttaccataggagtatccaacccttacaaccttcttcgaaggagaaataatcagcaaaaaacaccctttcttaactcgcaagtgggatgcagatgaagatgttgatcggaaacactgggtgagtaaatctgatctgtgctgggtcatctaggggctgctagagaattgaagaaatgctgggagccagagaccttgtcccttattgaggattactggggctttgcaaccaagtaaaaggttgcactgcacacagacctcagttgttccatcttccttatgaggacagtttaaatacgatctgacctgctgcttaaatagcaaatggttgtctgatgatagcaaccccagagttccagccagaactctgctcagctatcagaatcttaacagtgtccccccatccttcccacctgtttgtccatcttctgtccactgttcctttcaaatcacctctgcttggggaaaaccctgtgaaacatgcaatgatgacctccggcttcggggctggcatgagatggagatgatgttgtgggaatctgcctgcccactggcttatcagggcagagccacatcatttctttttatcctggctgctgacagacaagtatagtcttgtcttaagtacaccactataaatcctgctgcccccctttttaactgtcaagtgtagagcattctcactcagcagtagtgaatgcttcaagacagttagtgtcctgggatcttttcatttgttgtcatataagtaccatgtcttcaaaaatca

SEQ ID NO: 10542 - DNA, 1183 bp, Homo sapiens
caatctctcgcagatatcgaaggacaaggctatcatgtgtttctagtgtctgcttagctagctggcccaagcccctagatcatgcagagacacaagcttcacaaagccctcttctctgagactgggcaggctgtttctaagctgttttgcatggctctttttgctacttcggatttacttgcagaggtcttctcattaatttttcttagctttcgtctgtttattttgtctgtctgttcaccattcccatcctttggccttttcctcagccatgttaacaaggcaggtgtagggcagtggggccccagctggagtccaggtatctgccccagggttgagtctgcattcaatggggtgaccatagggccccatctgttacttggtcttagctgcccttttgggagccacgtccctagctgtcatgccttgggaaggtgagtttacctgggcacataagcatagttctgagagcagcctctccttctctcagtcaatcggcacactctcttttctgctttcagggcaagtttctggctttttatcagtatgcaaaatcatttaactcagatgactttgattatgaagagctgaagaatggagactacgtcttcatgaggtggaaggtaagttcccaccaggtggccctccagactcccagcaagccaggccctgtatcgcacctacatattcactctaaccaagggctccccatgtccagtgctcgtcacagctggttgtcatggcaaagtcttcatggcagggtctttgcacgcctataaaaagtgggcccagctccagggcacgcactggttaactgccgatgtcccagacagctcctcctcgctgtgcttttggtgggtagcaagtggatttgggcctaggtggctgcctctaacattgtcttctccctttcctttctcccacccaagaatcttgttgaacccccaagttgaatcactccaagtgttctgtggattcaaggcagagccaaacttgctttgaacttagtcatcagttgtacccagatccctctacaggcttaaacaccatccgtgggccaggtgccctccaccacatccttttcccagagctcaggaaagtctcacctcctctacttccctccagctcaggaaatgagggaccgggaatggaacacgggtttttgactcagcagacctcagag

SEQ ID NO: 10543 - DNA, 4051 bp, Homo sapiens
gggcttgggcgtgggtctccatcttctcccacagcttattgaggtctcctttttataaaacataccatagttaacttcatgattagagcagaatgaaaaaaaacattcatctagtgcatggttcaggaggattaaccaaaaaaagaaagaatgaatgaaatcaaactaggttcaacttgagaaatagaaaatgaatgtgcatttcagtccaagtatgtgacttgttgggtgctctgctttttgaggggttactaatgtcctttgctcagggtgcattagatgactacctcccgtttctgtctcctcccccttgcaggtatcagtccctcaatctaacccatgttcctgaacacagtgcacccatctatgaattccggtgacaacggttcagaacagcaaccaaataaaactgaacttggcaaaaaagaactttgccgagaaaattgtgtacctgccagaaccaggagaagtgtgttcctgtttcttcacgagcagactcgcatcacaaagcatgaatgttaacccacagaatccaaggagcatggctggcccgtggggcaggtggagggagcagtcttcgttcttcctcccctcagtggcagtttggtcttcacctgtttttaagctaccttaaacgcacttttccttcctgcacagctaacttctacatcactgaaatgcccattccttcctccgtcccacctccagccgaatagaaggtctgctcccggatcaccctcagccttggtgctcagtggtcccgaggccctagacccccaccccccgccagttgctttgtctggtagctcaagagaaggcagagccccagcacctctgtgccccccagagctctgtgcagggagttggccagctgccgcatcatcggccaccaagggcacaagaggcggaggctccagtccctgctgggctgcctcagtcttcagtgctgattgtgtcacgggtcagcgtgcgctgctgagccctgtactgttaacagtgcaaagctagtgagtagctgtcaggttccctgggcctgccatcagggatcactaaatttaaggcttccagatccctggcaggaacagattccagtcctgcttactcagtacatttgctccaaacttttcaacttgagggcaatactaaacttaaaaataagagtttttttattacaaaattatttttatggtccctttaacgaggaccctatggcaaatgcacaattattcagaattacattttatcgttttcacattgaaaacagcaaatgttgacttagtaatttttatatcgatatctatatgtatatgtatatttaatcaaccagcagttttgaaactagtcatcctggtacaaaagttttgcagcattgcctaaattatagtgctcaacacaagaactgtttttggggccagtttagcatttgtgccgcctccttttgctactcaaaacagcaatgcttggcggcagccttccatgaggcagaaggggtcgtcgttctctgaaaacagtgactctgaaatgttgggacaggggaaggggtgggaaacatgaacatgctcaaataactcgaggctcacgtgccaaagtgtgtgtgtgtgtgtgtgtgtgtgtgtgtgtgtatgatgttttgtttttttaaatgttttaaaagcttaataggttggcatcagttgtagcccacaaacatggctagggctttggggatttggcatttttctggtggtttacaagacttactccgaatacaagaggaaaagctttaaaaacaagattgcatcataacccccaggagcaaagcaacctggaggctgcatatccatgggcgggcagcataagagaatgtgaagcccttcagtgagacgagacgagcaatgggaaaccttttctgttcttaagaagtgactttaattttattgacatatgtactgtatgttactgagattgaatgttaggggaagccttaaggtagaggtatttgggaaagtagccagtgggcacttgtgatatctaaaatctgttatcccaggactgtgtacagaggggcaacctacccattcaggaaggtcagggctttggaaccctaaaaagttggcccgatgacttaaagggaaaaataattcattcccagagatgagtcagaacagtctcctcaatcctgaaattcaacaaggcatcagaagggctggctgtggtcaagcccagctgctgtcatgtgaggagatgctcactgtggtcttgttgagctgatggccttggttgagctgatggacaagtgaaggaggccatggggctgtgctgtccttcctgccgtacgtgccattccactctcttcagctctcccctcaacagcatgcgagcccataccttctgcatttttccaggcctgtgagggatataggcctccccttggagcactgagtccggaggtcatccctgagctcatccacggctcatgctgtggctccgagtagtggtttgagtgggcaggaagggccatttgcaaacactgctgtgttctagacaaacaacccaagtcctatggcaggatttcttccttccttccttttttacccaggtgatgaagtgcacccattgtactgggaagaatgaagaggtgatacctttactagatccttcagacacatctatgagaagatttgttcatttaaaagtctgcccactgaggatagggaaaggattaaggatttttccacctcctcttagtaactcctgaattaccaacatcaacttctttctctccgttcctgaaggaactttggggaatcatcttcatccgtagttacgctttcctgaaccttctcagtggtttacatgcctctgaaactatgtgcaatatttttggttgacacttgtatccatccttaagaaattagtgcagattgcagatgttctgtcttccatcccaaacaagcctgccatgaggtaggatcctaggggtttggctgttcttactccactgctcagaaagcttccattctgctgtcctcagcctcgaccctcttctgtgctggacttccacccacccacccttttcaagtttagatagtgtttcagctgctgtcccaaagtaacaaaacaatacctactgttaagtaggaagtcaatctgtgtgctggttttgttggttatgtggaaatcacaaactccagaggagcaaaggggtttttcaatgtcttttgctttcagaaacagagaatataatattctcactaaggccttgaattgatttttttctcataaaatagtctgataagctaatttttaaaaagaaatgccattaactgtgttgtatcgtggtttaaaattactaacaagttgtgggaaagaaaaataatatttgattttgaatcttaaatgtttttaaaaattagacttgaatgggcacaaagtataaatattttgtttctttatggaggacatgtggaaggagtttgagggtttgggatgggagaagtattttgcagagctatcaatgtccaaataatttaaaaaaaaaaataaaggtatttaagcagtgagtttgtcctatttgtaaaccaaagcagctccattagaggaaagcagtcctctctgggcctgtggctgtggagctctccagggccagccggagacctctgtgtgccagggcaaaccgagggcccctctgggcaactgttgcagtggtctgcttgctcctttttcattctgaatgttttcagctgctcagcacttctattcaagctccattttgttaatttctgtatttcttcagaaatgtggaagcattttttttttccatatgtgaagggtttatatttctatttaacacagagaaaatgtgcaggcagaggtatctgtccaaagcctgctttgtgttctggtgtggggacaggcaatgctgttgggctgctctcgacactgtgactgtggtcctcagagaagatgcctaagtctcaaagcacaggcacttggacccccaaatagcaggatccctaaatcagccattacagtttattctgacaaaccattctgttacgtttcaggtccc

SEQ ID NO: 10544 - DNA, 1571 bp, Homo sapiens
aagaagccccgttgtcgccaccgttgcatgacccgccgctcctgaggccctaccccacgcccggaccctcgacgccccccgccgggtcccccactcacgcatgggggttcggcgctaaggacccccctccctccgggggccccggggcgcgtccccttagagccatgcccggctgccccgcccgccccggaggaccctagagcagcgtcgtgggggccatggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcaggtaacccacccgggtggagggggcggccctgcgcctgctgccttagctacccaccctggcccagaaagcagcagcccgtaggagtctgcgttttttacagttctgaccagttcttctgtttgtagattgtagggagcgagagaagggttttgtgtttaagatacctatagcaagaaaatagggaaccgatgtggaaatcctgtccccgaaggcaggtttgacgggatcactgacttggctgagaattcatcgaaagccatcttttcagaaggctgttccctttgatttttttttttcccaccatccatttcttagcataagtccctttgtgattttccggttttccattctggccttccatttacaaatctatgctttaaaattttttttttttttaatttatctaaaagtctttcttgttctgccatttttggattccttaacagagaaagtagtcacaggcaaaggccccagagattatttaattgaagcacattctccattcccaggagggggagtgacttccctggagttgaacagattagtggttgggccaggcatacagagcagcacactcttaaaa

SEQ ID NO: 10545 - DNA, 2146 bp, Homo sapiens
cctccgataccagggcctctgccaggactacccttcgttgaggaccactgagctgaagtgacccatcccaaggatgagacgaggtacagcggtaaagccaggcgcctcctgccagcctctcagataacgtcctacctccctttccttgcaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttagggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataaggaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctaatatattttgaaacagttgtctgatgttgttgtaagagagggcttgcctttggtgcttccttaatccctttactttcttaaacttgaaacaggggttggggaggcagagctagctcattggccgccagcgtcccagaggagttggttggtcttggacactgggcctcctgtgtgcctagccttgggtttatggctgaaggtggacttgccctcaccccactgtcctttctcccactccaaggagggtgaacttcataaaccacaatgtccag

SEQ ID NO: 10546 - DNA, 1327 bp, Homo sapiens
cctgagctcaggagttcaagaccagcatgggcaacttggcaaaaccccatctctactaaaaatacaaaaatttagccaggtgcgtttagctgtggtctcagctactagtgagactgagacagacaagaattgcttgagcctgggaggcacaggttgcagtaagccgagattgtgccattgcactccaacctgggcaacagagcaagaccttgtctcaaaaaaacaaaaaaaaaaattcttgagttcctattgtataccaagccacactgggaccccaatagtgagcaaaactctggtccctcctttcaagatgctcatgatagtgtggagtgcaggtactggcatgaagcagatgtttttcaatgggtaaggctggggcccagagggctttagtccctccagacttcagacctggctccctatgcctggtaaagggcttctatctagagtctcttactctgttctagtgctcagagctagtctgcttggccaaattcttgctgtggaaacttggataagctgcttacctccacatttaccagagaagagagactccagagtggggcaagtaactggcccaggcttggtctaaaaactagtgcgagggtctgaagagagaggggccagagtctcaagtgtggtctggggctagttgggcctggaggggtagacactgggctaggcagagtggaccttggatcccctggagaaggaaacaccggatctgagagaaagtgacttgcagaatgtcatccagagtataaatggcagaagtaagcatcccccactccatgcctgagcttctgactcttggggcatgggataggggctcagagaagggctgggggagtgcgaggaaccgtctttgtggaggaccctattttccattgccattaaaaagtcagacttctggccaggcgcagtggctcatgcctataatcccagcactttgggaggccgaggtgggcagatcacgaggtcaggagtttgagaccagcctggccaacatagtggaaccccgtctctactaaaaatacaaaaaattagctgggcatggtggcgggcccctgtaatcccagctacttgggaggctgaggcaggagaatcacttgaagccaggaggcgaaggttgcagcgagccgagatcgtgccactgcactccagcccagcggacagtgcgaaactccatctcaaaaaaaaaaaaaaaaaaaaaaaactcccagcctgaccaacatggtgaaactccatctctactgaaaatacaaaaattagctgggcgtagtgctgggcgcctgtaatctcagctactcaggaggctgaggcagga

SEQ ID NO: 10547 - DNA, 1441 bp, Homo sapiens
aggccaggtgctgagtcccatcaacccctgtccctagcccagtcttctacacagtagatgctctaacagctggtgccatccctcaccccgctaggaccccatcccattcctccaacccttttgtgtggaaggggaaactgaggcccagagaagttgactggccagaggtcacgttcacgcattcaaaaaatagtgtctggccaggcgcagtggctcatgcctgtaatcccagcattttgggaggccaaggcaggtggatcacttgaggtcaggagtttgagaccagcctggctaacatagtgaaaccccatctctactaaaaatacaaaaattagctgggcatggtggtgcgtacccatagtcccagataactcgggaggctgaggtgggagaatcacttgaacccaggaggtggaggttgcagtgagctgagattgcgcagtgctggagatacaagacagacctagtatatgatgtcatatacgcataaagttataaattttactgatgtgaagtatagcatataaatattatttttgagatggagtcttgtactgttgcccaggctggagtgcagtgagtggagtgatctccactcactgcaacctccgcctcccgggttcaagcgattctcctgtctcagcctcccgaatagctgggattacaggcacctgccaccatgcccagctaattttttgtattttcagtagagatggggtttcactatgttggccaggctagtcttgaactcctgacctcatgatccacccacctcggcctcccaaagtgctgggattacaggcgtgagccactgtgcctggccagcatttaaattattaaaacatatatattcttataaattccatataaccaatcttttctcacagaaatctattttagtttttttgctgaattactgtatttgtagtctgcttgtgcttataattcagccatgatatgacaaagggacttgcatcatacctgcttgtaatagtttcccgtggctgccataacaagtcaccacaaccctggtggcttaaaacgacaaatttatttctctcaaattctgggaaactcaacatcactgggcttgcctgtctagtggaaaacctgttctttgcctctgacagcttctgttagctgttaacattccttgacttgggaacgggcagattcacgtctctgcctccatggtcacatggcctcctcctctgtgtaccacatctcctctttttttttttttttttttttttaaagacagagtctcactgtcacccaggctggagtgcaatggctggatcacagctcactgcagccttgacctgccaggttcaagcaatcttcctgccttggcctctcaaactgctgggataacaggtgtgagccactgtgcctggcttctgcctctctcctaataggacattcacgattggatttaggg

SEQ ID NO: 10548 - DNA, 1134 bp, Homo sapiens
ggtgacattcacaggtcccagggataatgacccgatatttgtggaggccatggatcagcccctacatgcccttctcccagtaaagttattgccattaaatctgatatatcatctgctttctcatcctcaaatattagttggattaaaatttctcagctatagcagtacttttaaatttaatctgaatcattaatattttccttcactttctcttttttttgagacggagtcttgctctgccgcccaggctggagtacggtggcatgatctcggctctctgcaagctctgcctcccgagttcatgccattctcctgcctcagcctcctgagtagctgggactacccgccaccacgcctggctaattttttgtattttttagtagagacagggtttcaccgtgttagccaggatggtcttgatctcctgacctggtgatctgcccacctcggcctctcaaagtgctgggattacaggcgtgaaccaccacatccggccctcttcatcactttcttaaatctagacctgtgttcttcagtacagcagccactgatacttggctattgagtatttgaaatgtggctagtttgaattgaaatgtgcttttagtgtaaaataccagaatttgaagagttagtatgaaaaaaacaatgtaaatcattaagaactttatattgattacttgttgaagatactattttgagctgggcatggtggcctacgtataatcccatcactttgggaagctatggtggatggattacttgaagtcaggagtttgagagcagcctgaccaaatggcaaaaccccgtctctactaaaaacacaaaaattaggtgtggtggcgctcgcctgtaatcccagctacttgggaggctgaggcaggcttgcacctaggaggcagagattgcagcgagccaagatcgtgccactacagcctgggtgagagagcgagactttgtctcaaaacccccccaaaaaagaagaaaaaaaaaactattttggacatatgttaaatttggacatactgggttaaataaaataggctgaggcaggagaattgcttgaacctgggaggcggaggttgcagtgagcccgagaccgtgccattgcactccagcctgggcaacagagcc

SEQ ID NO: 10549 - DNA, 1250 bp, Homo sapiens
cagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcggggggggggggcaggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgctcatgttccttggaccgcatgtgctggatatatacctggcaaggggacagcgagccttgggtgatgaccctgccctgcccaca

SEQ ID NO: 10550 - DNA, 1134 bp, Homo sapiens
ttctggaccctggtgggtggagttggcccctggttggtcgcatgcccaagggggcagcaggcccagtgagggctcagctgtttgcccctcccctaagcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggtgagccaggccagggttgggacaaggcagggagccttagcttctgctgaaggccgaccctggccttgaccctggccaagagggacggggggtgctgggcagaaagaacagctgtgcaaaggccctgaggtgtgggtagcaagtaaagactggcctgagtggcttcacagagtcaagccgtgctctgtgactctgcccccaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaaggtgagggctgggcatgctgttaggggccatgtggcccagtaccttcctctaagatggctcagtccccaactccagagttttgttcagggaggccaggtgggaggtgggcaggctgcaggaggtggtccaggcacaggggcagtacaaagcccctggggctgggaagcctgtgctgttcagagtggcgtctccggggtggccggaagaccaggatgaaagctgatgtggccggtgccttggcttccagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgccagcccgttaaaattgggggtgggcagagtggggttcccagggaactctggtgc

SEQ ID NO: 10551 - DNA, 1477 bp, Homo sapiens
tgttccacaaaaattatgctgaaatggacctgaatcagccctgggtgtgcttctgttggcgcctgctgctgaggcccggcctgcccatcggcctgtagtacgccatcgaggtcatcatggagccagccagcttctcttctcatcaaggaggcagagacccctggtggaagccaagagtgaccgaagagggcttgcatcacgtcactccagtggttccctccttgtccaagtcctcgttttaagggcatggcccgttggctccagccgttggcttctgttcagggtccttgctcccatcagaggtgtttgattttgctcctggggctgcgatggagaaccttttgtggcagatggtgctgcctacatctcattggttctctgtacctgtgcccgttgcgcatgttcacagacaggagagtcgccagcaataccttggcagcctttaaatgtgaaacgtctgttacttgcgctggaggcagaggctgtgcagggagcctgcttctaatcgtgggctcccttatctgttacggttccctcccctcctgttctagatgctgattcgttttctcactggctggttaattgctgtctacttaggcctccaaggccataactgtgcaacattttatctgagaaggaaggaaggtcagaaagtgatcactggcaccaccactgtggcattcctgtcacaccaacacagaaattcacagctcatactgttctcacctgggaaacttgggaagggctgatgagtttggggcagatcctgaattgcagccacacttggccttctagaagctgaagttgtgccctcaagtggtcctaagtagaagtccacttgaggtatttgctggcacacaccctcaagggtggttcagaaggtcctgaaacctaaggcaaaaggctgctggggcatgaacagaacagaccgtctcaggggcagccatgtaagtggcaagcagggctggtctccctcaaggtggttcttcattaagtaaagatggcttcgtgactagtgtttagctcccagatttatatttgggttaaaaactaacttttcaatgtggcagtttcaaaggattacttgatgcaaagtatgtttcctttcaaagggatcttgacgtggtaccaggactgagtcatgatttgggcagaggcagttaacactgggaagccctgcccctccctatgcccccttcactccggggaactgaaacctactctgagtctcacatctctaaacctcagtgctgagacctatgcagtgggactaatctcatcaagaattttcagttgaggccgggcgcagtggctcacgcctgtaatcccaacactttgggaggccgaggtgggcggatcacctgaggtcaggagttggagaccagcctggccaacatggtgaaaccccatctctactaaaaatacaaagaaagttagccaggtctggtggtgcgtgcctgtaatcccacttactcgg

SEQ ID NO: 10552 - DNA, 1101 bp, Homo sapiens
gaagaccactttggtagcagaactgtagggactggtgagtcaactcacagattctgcagcagctgctccacccacaataaagcaaacgccgacaggctagaccccagattgcaggggctgccacctacaaggtgggaccacaggctgcctcaccgggattgtctgccactaaatagctggagtcacagattgagataaatgccaccttcaaggttgcagtgaaaagcataatcctatgtgatgaatttatatgtgttattttttaaaaagctattttattactgcatgttcccgtcccgtcttgtgaatgtgagtccccgccaccacgtgaggtgcagtcgttgcagcggctggtgcaggagtgcagctggcgcgtgtgtgatagcatctcgtaggtgttgctgcacaagagttaaccagagtcaatgccaaacacatagtatgagaagtgtactttttaagaaattaatttatttgagttcaaatatttttgaaatataaaaattggttgtattttttaaagctataattcttgtagacattctgtggttaaaaatttgattgtgcttattaaaaatggtcatctatgttttgcacttcagctacgtgaaaataaaatttctttgggaaggtgacatttggcttcctgattacgggagggagttggttatctcaggtggagcaggaaagcctggttgattctcacaccaggatgggactgggacttcccaggatggagggaggaggccatttctacaccatactttgagctactgacagcaaaaccctcccaccatactgggtgcatcttgtttactcttgactaacatacacttctgatttacagcagaagcctcagaagctaattcagttctcctttggcatgccactggataacaagatagtgagggggcagtgtgtacaagctgtggacatgggcatttcctctctgttgcagcaaggcggaggaaagcccagggagagtaaaacgctacaatctttctaacagctttgccctacaccaccatctaaatgattatgaccaagtggcgacatagtattttattttcctagaattatgtccagctgtgagaaagccag

SEQ ID NO: 10553 - DNA, 1380 bp, Homo sapiens
tttggaagttgccacatcttattgtgtgtatttagtttctgattgtgatgagtagctgagaccctgccactgaaagacaattctgcaccaaggctgagtgttggggtgggagacagcaaaaaacacatgtaaatcaccttgtctgagagggttataaatttgggctgcccaggacatctgtccaagggtgggtgcatctcagagtaattgaggtaagcatggagaccttgtgccctgccacactccccagctgggggacattctgacatttgtgcctcggcccccagccattgtaccccctttggtgtgtagtgtggggtgactcatttgtgtcttgtggcacagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatt

SEQ ID NO: 10554 - DNA, 1147 bp, Homo sapiens
aaactctgttagccttgctgttgtcaccttaccactttgataataccatcagcctcacaggatccgggaaaaacctaccacaggctacagtgtctggcacctaatgtgctctgtgaacatgccccttaccccccaaagtaaattgaactgctgcccaatattcatgctgccttcaggggagcctttaccatcaatgttagggaattgcccaagcaacttgtcagagaaaacaagccaggagcagcctgaggaagctgtcccttccccatgggagtgtcaggccctctgctgtatgatcagttacccctttcaaaagtgctctgtccttcctttcacattcttaggcacgggcatctctcgtggggattagaatcccaggccatgtggtgggggtgctcaccttcctgacctcatctgctttgactgccttcatcctcgccttcgtttctcagagattccttcacggcatagaattcgcctgcatttctacatgtccaactttgtttccaggtggttctgacaaccatttgatccttgtggatctccgttccaaaggcacagatggtggaagggctgagaaggtgctagaagcctgttctattgcctgcaacaagaacacctgtccaggtgagaatcatccttgccttctccttcactcctctcccatctgcatttcttctggccaaagttgtagctgatgaatatattggctccggggacagacctcacataaaaactgtagtgggggctgggcacggtggctcacgcctgtaatcccggcactttgggaggccgaggcaggcggatcacttgaggtcaggaattcgagaccagcctggccaaaatggtgaaatcctgtctctactaaaaatagaagaattagctgggcatggtggtgcatgcccgtaatcccagctacttggaaggctgaggcagaagagtcgcttgaacccgggaggcagaggttgcagtgagtggagattgtaccactgcactccagccttagcaacagaatgagactctgtctaaaaaaaaaaaaactgggccaggtgcagtggttcacacctgtaatcccagcactttgggaggccgaggtgggtggatcacgaggtcaggagattgagaaggctaacgcggtgaaaccctg

SEQ ID NO: 10555 - DNA, 2739 bp, Homo sapiens
agtagcaagaagaagtggggggaaagaggcacccataattctattacccagagtcaaaaacatcttttaacactttttctgtgcattaaaaacaaaaaaagaaaattatacctccatcatttctggtgtgacctgcattgtgacagcacaatgttggccagttatggtgcagaaaacagtgctacccctgggagcctggagtgtggtgggagatagctccaatagtggcaggtgctgtgcaggaagaggctcgtgtgaaagtactggagggctgccatggggcacggtgatggggacatggggccatgccgtctgcacaaggccaagtggaagagcagatttttcacggtaaatgtaggcagaccctttttttttcctggttgtctaacctattattgtagaagtgctcatatacattcttttccatctgtgctttggcaggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtaacagggtctgggtgtgtgtgggtacagctgcctgggcttttggcacatcttgatctttagttacagagagtcaggacaagactgagatcttttgtggctgagaaacgattcaagggctgggtgcagtggttcacgcctgtaatcccagcactttgggaggccgaggcaggtggattacctgaggtcaggagttggagaccagcctggccaacagggtgaaaccccgtctctactaaaaatacaaaaattagccgggcgtggtggcacacacctgtaatcccagctacttgggaggctgaggcaagagaatcactggaacccagagggcagtggctgcagtgagccgagattgtgccactgcattccagcctgggtgacagaatgagactcttgtctcaaataataataataataataataataataataatgtgtacaactcattggtttttagaatgttcagagttgtgcagtcattaccatagttggttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttcgtatttcatgttgatagaaaaaattttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacagagcaagactccgtctaaaaataaataaataaataaataattgaaacattgacttgagacatagatccactgtgttttcctgtcgtggcaagcctcagatttgagaagctgtcacatttccagatcaaaccatgaagctacttggctttctgatgctgtggttttttttcttttgcttcacaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatg

SEQ ID NO: 10556 - DNA, 1266 bp, Homo sapiens
gttcctgcctcaggagcggaacaagctcagtgatgggacccaggccacccgcctcctgcccagtgtggcccctgacataacagcaggtagagctggtctttggagtcagcctcccctctcatttccacagcccttgccctgcccaggacctctgagaggacgtgtgggcttggggctacgtgaagcatctggtacttttcttgacttgggccagctctgacaatgtgtgaactggatagaaccacaggggcaagccaggcccacacccccatttgacagatggggaagccaagggcccaggaggggctgtggtcccagatgccctgattcctgcagtcattcccagaccaagccagttggtcttgttctcagttgataaaagctccccaggaccttccttaaaccaggccccgtcctgggctcagacaagggctctgctcttgctgagctcatggtgtcacaagtgagctgggcctcccaacagaattaggcaaggtggcgaatgcctctgtgcttcagtttctttatctgcaaaatgggaaaaagaaccactgcctcccggtgtgcttgtgaggcctgaacaaggtaacagctgtaaaggctccttataaaccatcaagcagctcaagggcccaggactgatgcccagtctcttgtgcagaaggtgctctgggtgggacagggccctgggttctagcctcagtcatggactgtgatcccagctttcctgtctataaaatgggaaagggcatgacaggactcaagggcccccaagaaacctttgtggctccatggacaggccaggctgttgggggttgcctgggggagcaccaggctccccctccccatccccagcataagctcgtgcctgttacaaacccatctctgaccaccctaggcactgaacccaatgcctggggagagccaggactgtggggggatccattttggagtgcaggctccaacatatccaacctgacagcagatggtccctggatcaggcaccctgcctggctgagggcaatgtggggagtggcgcacatggtgcgggtcctgctggggcacgtcccccagcccaagcccagggcaagtccccatctgccacggtaggcagggcctggtgccctccagggagaagcatgcctactgcgccctcattaggctcctttccagggtggcacgtgaggctgtttgcctgctcagaagtggcttaactaaggagattctggggctggagaggctttgggtctgggagatcccaggcag

SEQ ID NO: 10557 - DNA, 1219 bp, Homo sapiens
cctgtcaggactgctgtcagtcccccctgttcccaaatgactagaatggaactagtggacagcaggaccaggagccaagagtccgtgctctgcctctgcctgactgtgggacctggaacaagccccagctcctctccaagccccggtcatcccatctgtaaaatgggaacaggtattgaagactgttaggggccccttcagccctgacaccttgctgccctgtgatcctagactcccctgggacaagaggcgggtgggtcccaggtctcactctcagcagcttgtgccctccagcctccctccagccctagtgggctcctactccaagatggaaggtcaactgcctgcccctcccctagccccaggagccatgatttatctgggaaaaaacctgctgtggggttccaactacataccagaggacgggcttgtaagatcacgcctgggaggggcgagccccggcctcacttggctgcagcctgagaaggcgtgaggctgggctgggttggggcttcctcagccagagctggatgtagatgttctagctggttgctcctccagcagatgctgagcccccctcaacaggacacagcaggggggccttagcaggatccctcaccagccccagggtgaggccccagggcagggacagatcacaccttccttatttcacagttgaggaaactgagggcaggtgaggcgccggtggccagggccagaacactgatctctgcatgccaggccagggcttgggaacagacccagagaaataaagtcgaacccaggtttcacgaagcctgattcaccccacattttttctgtcaggcccccgccttcacacactgaagtcctggcccacagcttggctctgagagaatagaagcagcttaatgaggtgcttactaaatgccagccccgcgccaggtgctgagcgggcactttaccatgctgtgtaatcctccccacaactctggaaagtaggtgttgtctccattgtgcagatgaggaaactgaggcttggtggggctcggagatggcaaataactggcctgaggtcacagaactgatatctggagggactgggccgagacccccagtctgcaggccctgagcaccctcccattccctggagaagcagtggcactgttccttctgagccctacccctgcatgggagcaccagagcctcactgctggatcctgttgactcaggacagtaa

SEQ ID NO: 10558 - DNA, 1181 bp, Homo sapiens
tgtagagatgaccaggacatggctgggctcttgacaagctcatcatcatccagtcaagacccagaccccttctacaccacaggccccggggctccattggcctcctctgttacagtgctactgaggccggtggagcccctggctcctgactggttgatgttgatgatccctgatgacacatggggtggtcttgagagtggggagcatgcaggtgcccgaggaggagggccctcaggctggccctggatggtggctggcaggtgggagggatggcgttctggaggaggtccacagcctgggcagaagccagtgttagcctggaaaagtctgttgagccctgaggtctctgaagtctggtgagggggtttagcaaacagtaaatagcttgttgtgactggagagctggctggacggggagggagatgggacggctcagtttccaagttcttctcagcccctcctagagggcttcactggaggaagaggcacaggtgggtgatatttatggctagttcatgagtatttgctgtaactgtagcatagtaaaacctgtccccttctctttgtcttaaaagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaaagaccccattactggtctcccgtgcttgcctgctggatgggtgaggggcagggcagtgcttcttgctgtctctcacccacttgggtctggtcgattgtggtgggtgtccaggctcctccagccctcagcagtgatatccaactggcccttgccctcctccttgaggatggtggcatggtgttccctctttgttttgagtggttttctgctttgggagaaggaaagtcaacctcccctcaacctcccatttgcatcagaaatggcttgtgccttctctgggacatgtttcaactcttgcagcctcagcgttacacccagcgtcccagctgaaggaaccaaaatacacagcatggaacatccaaatcaagctgctgtaattagatggaaattatgatgtgcttaccaccactgctgatgaaaaggggat

SEQ ID NO: 10559 - DNA, 1100 bp, Homo sapiens
agcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgctt

SEQ ID NO: 10560 - DNA, 1219 bp, Homo sapiens
ccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagaggtgccttgtgggcaggtcgggtgggcagaggggagacttggacttggacaaggcttcaggcttttaccttctcccctgcccaacttccccgcagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgccc

SEQ ID NO: 10561 - DNA, 1641 bp, Homo sapiens
cataaagactgagagagaaggctattttttttcaaatgcgtacaactcaacaaaaaaaatatcacaagccacacaataaagcagggaaatataaccaaatcaaaggaacaaaataaatctctagaaactgcctccgaagagatggagatctataaactatcggattaataattcaaaataattgtcttaaagaaacacagtggcttcttttccgacaaaacaccaaatggcggatgacgccggtgcagcgggggggcccggaggccctggtggccctgagatggggaaccgcggtggcttccgcggaggtttcggcagtggcatccggggccagggtcgcggccgtggacggggccggggccaaggccgcggagctcgcggaggcaaggccgaggataaggagtggatgcccgtcaccaagttgggccgcttggtcaaggacatgaagatcaagtccctggaggagatctatctcttctccctgcccaattaaggaatcagagatcattgatttcttcctgggggcctctctcaaggatgaggttttgaagattatgccagtgcagaagcagacccgtgccggccagcgcaccaggttcaaggcatttgttgctatcggggactacaacggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggctgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcaccaaggccacctttgatgccatttctaagacctacagctacctaacccccgacctctggaaggagactgtatttaccaagtctccctatcaggaattcactgaccacctcgtcaagacccacaccagagtctccgtgcagcggactcaggctccagctgtggctacaacatagggtttttatacaagaaaaataaagtgaattaagcgtgaaaacaaaacaaaaaaaagaaacacagtgaccttcaagaggacacagataattaaatgaaatttttaaaaatgcaacaacaagatgagaaaatcaacaaagagatagaatgataaaaaaaagaaagaagcggaaatttttgagctgaagaatatagcaactgaattgaaaaattcactaaaagagttcaaaagcagacctgatcaaacaaaacagtggactaaacaacaggtcatttgaatctttgagtcagggagcaaaaagaagaaaaaatgaagaaaagtgaggatagcctaagagattaatgggacatcatcaagcagatcaacatacacattaaaggcattccagaaagagaagaaagagaacttatttaaagaaataatggctgaaaacgtcccaaatctgacaaaggaagtggacatccaaattcaacaatctcaaaacaaatattagtaaattagtaagattattagtaagatgaactcaaagaggc

SEQ ID NO: 10562 - DNA, 1553 bp, Homo sapiens
acctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcatagatggtatttgtcaactttttttttctcattttaaaattcttagctgagaagattttctcaaactttatgttctgctgtgtgtgttgggggtggtggttagtagctatagtaaataggtttttccagtggcatcctcctacccccagttgctgatctagaacaagtgtttctgtaagcatatttgtagaacactaatcccgcaagattttacacaaaaaaatggtcctgccaccagtcctgtataccactggctt

SEQ ID NO: 10563 - DNA, 1309 bp, Homo sapiens
gtaactattggtttagtaaatattcacccattcagtcaccctgtaagtggcaggcactgtttacagggacacaggaaggaataaaaacttgcaggcaccttggagcttgcattctattgaagaggtaatggaagttgggatagcagctaaactatgctggtattggccaggcgcagtggctcacacctgtaatcccagcactttggaggccaaggtgggcagatcatgaagtcaggagatcgagaccatcctggctaacatggtgaaaccccgtctctactaaaagtaaaaaaaaaaattagccaggtgtggtggcgggcgcctgtagtcccagctacttgggaggctgaggcaggagaatggtgtgaacccaggaggcgaagattgcagtgagccgagatggcaccactgcactccagcctgggtgacagagcgagactctgtctcagaaaaaaaaaatatgctggtagttttgattcaagatggcctttggagcccatgatttaggtctcgtacccaccaaggtctactggaaaacatcaggctctcctgctatagacccatagggagagctgcagccgagagggggagctgaagagaagtgccccttctgtgtcctgtcagcctcatccttccgcaaggaccagttgctgtgccactccattcacttgctgcaagactggaggtttttcctcaggtgttgagcacctggtttacaagatgtcagcatcttgatgcctgagaccatcaaggcaagtctctgaacagggcttaccttagagtaaggcttagaagaggccgtaaagtcagtctcagctccgtggctctgcagagctttgggacatgtgaattcttaaaaacaagactattgtacagttactatatgcatgcagtataaaattataaccttggaaaatcctagctagctgttgagctaattccataaagtaatcagctcctgagttctgcagtggtaataataatcagcataatgagtaaacactgtgtgtgccaggcagcgtctcatttgatccttgtgataatcttgtaagtactgattttctcccttctttaaacaaagttttttttttttttttagagagggtctcactatgttgcccaggctagtcttgaattcctggcctcaagcactcttcccatctcagcctcccaaagtgctgggattataggtgtgagccaccatgcctggccattttttcccttcttataaagaagacaagcttaagaggtaaaggaggccaggtgtggtggctcatgcctgtaatcccagcactttgggaggccaaga

SEQ ID NO: 10564 - DNA, 1151 bp, Homo sapiens
tgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctatttaaaattgtgtcaactttctgctttcagggcatttatggctcttctgttgaaatatattgatctttccaaatattttcatttgctttctaaaaacccagaacatgagccactactggactttgccttgtgtttgaagtgtatggcataaacccaaggtttttattagtcatctatgctgtgattaattcattttgttcttttaacaaaatatttccatccacttcacattgcttcaatctttaacagaaaagcaatataaaggttatagaataaaatgtggttttgggcaactcttgctgcctctgcatgttttggaataacaatttctacaagactctaggctgtttaaactagtgctttcagttaagataaattctaatcatttctttgtatatacattttgtgcttctgagctagagatgccaagtagttgtaaactgcttataaagagaatagcagcaaatttgagactcggctacttttttctgccccacctgctttgagacacagaagcggagtgtggcccgaaattattagccagatttaatatttgatctaaagtaggtccttgtactcattttaaagttggaatttgattcctccaacattgagcacccaccatgttccaggctctgtgcattgtgcccacaaaataagattccctggtggagtttttatgggttcaaataatcagttgaacacccttcatctttatcatgttgttgacattgacacaaattgtttaaaaagaaaagatattagagagaaagtggtacctttgtaacttgatgtgtcttcatcattcggtaagatttgatgaaagtaaaaagcaaatgtcagccaaatccagtgaacagcaataaaacagggagtaactttttataactttttctacttggatttcaacattcagtagagcttttcgaaatgta

SEQ ID NO: 10565 - DNA, 1134 bp, Homo sapiens
agtcttgctccagcgtccaggctggagtgcagtggtgcaatctcggctcactgcaacctccatctcccaggttcaagcaattctcctgcctcaggcctcccgagtagctgggattacaggcgctcaccaccatgcctagctaatttttatagtttttagtagagatggggtttcatcatgttggccaggctggtcttgaactcctggtctcaagtgatccgtctgcctcggcctcctagagtgctgagattacaggtgtaagccactgcacccagccttatgcattataattttaatttgtaaactgtacaaagggataatacttgtagtacaacaagaagtaaaaacatttgttataggtagttaacatttgtaaccagtagaattataggtaaaatttatttatttaaaacagttttagttggatttgatttcaactttaaaataatgcttttcatctctatcaggtctttttgcctggctttttgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcaggtattgactgattgcgtctgccattagggagaaaagcatacacatcctttccttcacatcccagtaacagatcctattatttgtaaattttaagttgtggaaaaaaaagataaaagccaggcacagtggcctgtgcctgtaatcccagcactttgggaggctgcggtgggcggatcacacgaggtcaggaattcgagaccagcctggccgacatggtgaaaccccatctctactaaaaatacaaaaattagccgggcatggtggcaggcacctgtaatcctagctacttgggaggctgaggcaggagaatcgcttgaacccaggaggcagaggttgcaatgaaccaaaatcacgccactgcactccagcctgggtgacaaagtgagactgtgtctcaaaaaaaaaaaaaaaagagagaaataaaattagcctacttactatcttctaatcaaagcatttgtggtaacttaaaatatactgtattgtaaagtat

SEQ ID NO: 10566 - DNA, 1214 bp, Homo sapiens
ctcaaaaaaaaaaaaaaaaaaaaaaaaaagaatttacatggtctgaattgccattaaaagagatatgagaattattgagtaacaaataactttttaataatttaggcaagttttggacgattgtactttgtttagaaaccaaaagcatagtatttgtagtttttttatttactttagttgctaggaagtaaactttattcaaggtctctggtaccagttgttgctaaaagtgattgactaatctgtcaatctgaaattatttgttgctgaactgctaattcttttgcttctatcttttaggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtgagtatgtgattttcttgtgtgtacatatgtgtctcactttctttttttaatttactaagcagaacttcagatgaggaataaaatgattggaatattttttttctcctctaactacttgtaaatttgggagaatttggagagtgtagtagagtcagatcagtgtatggaaaaggagcaggagtgactggaccttctaagaagtgtgttatcagaattagtaaatgaagggtcaaatgtcctacttttcccctccactgattttgacatcaaaccattatccacatagccttatttcctccctcggtcttaattttattaatattttactgcactttgcagataaaatttttaaa

SEQ ID NO: 10567 - DNA, 1205 bp, Homo sapiens
tggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagaca

SEQ ID NO: 10568 - DNA, 1381 bp, Homo sapiens
tgtgcaacaattctagaaactggaacaacttaatcaatatccagactttagcaactacttgatttttgttcttacaaaattaaaatctgaagatgaacccacaagttcattgcgtggtctcatcttgaagaataatgtgaaagcacactttcagaacttcccaaatggtgcaacaaacttcattaaaagtgaatgtttaaataatattggtgactcctctcttctgattagagccactgttggtatttcgatcacagctatagcctccaagagagaattgcagaattggcctgacctcttaccaaaactctgtagcctgttggattctgacgattacaccacctgtgagggagcatttggcacccttcagaagatttgtgaagattctgttgagattttagatagtgatgttttagattgtcctctcaacatcaggattcccaaatttttacagttcttcaagcacagtagtccaaaaataaggtctcacgctgttgtatgtgtcaatcagtttatcatcaggactcaagctctgatgttgcacattgattcttttattgagaaatctctttgcattggctggtgagccagaggtatggaaaaatgtgtgccgagcacttgtgatgttgttcgaagtttgagtggatcgcctgctccctcacatgcgtaatatagttgagtatatgctacagaggactcaagatcaagatgaaaatgtggctttagaagcctgtgaattttggctaactttagctgaacagcaagtatgcaaagatgtattcgtaaggcatcttcccaggttgattcctgtgttagtgaatggcatgaagtactcagatatagatattatcctacctaagggtgatgttgaagaagacgaaatgattcctgatagtgaacaggatatatggccacgttttcaccgatcaaggacagtggctcagcagcatgatgaagatggaattgaagaggaagatgatgatgataatgaaattgatggtgatgatacaatttctgactggaatctaaggaaatgttctgttgctgccctagatgttcttgcaaacgtgcatcatgatgaactgctgccatatatattgccccttttgaaagaattactttttcatcatgaatgggttgttaaagaattagccatcttgggtttaggaacagttgctgaaggtttgcatgcagggcatgattccttgcttgcctgagcttattcctcaccttattcagtgcctctctgataaaaaggctcttgtccgttccataacatgctggactcttagccgctatgcacactgggtagtcagccagccaccagacacgtacctgaagtcattaatgacagagttgctaaaacgcatcctggatagca

SEQ ID NO: 10569 - DNA, 1359 bp, Homo sapiens
gttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttg

SEQ ID NO: 10570 - DNA, 1109 bp, Homo sapiens
gctccatgcaccccagctgtgagtcagaacacaacggccccaaaaccaaaaacctcagcaacatatgtgatgttcccatcttctgatgacggagtacacagttggtaaacctgcattcctttgagggcagcctatcacatcaacctccagttgctaaccatgttatataatggagaggaaaggacagcacctggacaccaggtgtctctgagtgtggcagccaacagcatccaaggagaaatgtcctctcatttccatctaaagggagagcgcccttcattgctgccatttcctggaaacctgctgtgtgctcggcactttcattcaaccttagactcgggctgagctttagacaggtgctgctgctgtctcagttccagctcttgcctgggtctactgtctccagtgtgaacactaaggagacccttctcttccatgtcaggagggaggttgacaatttacctggaaaatgaagaacgacccatcacatctgtgtccacattttacccagaggctcctggaacgtccaggaagtgttaggagctgggacaagtcaccagatctaatcacccatttgtcctcctaccaaccaggaaacctgaaaccctctgacaccctaaccaaagactggctgtggccatttttatcatctgtctagggcagctgtttaaaatacaagctcaggccaggcacggtggctcacacctgtaatcccagcgctttgggaggccgagacaggcagatcacgaggtcaagagattgagaccagcctggccaacacggtgaaacccccatctctactaaaaatacaaaaaatagctgggtgtggtggcgcgtgcctgtagtcccacctactcgggaggccgaggcaggagaattgcttgaacccgggaggcagaggttgcagtgagccgagattgtgccactgcactccagcctgggtgacacagcgagactccgtctcaaaaaaaataaataaataaaatttaaaaaaataacatgttgctgaccatgttatataatggtcataaaatataggctcaacgacgccagagttgggatgtggtgcaagatgtcggtatgatgtgctaggagatttgtaatccaat

SEQ ID NO: 10571 - DNA, 1180 bp, Homo sapiens
cgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttcaactcccgctgttctctctttccatgactgcccgcagctgctgctgcacatctgctctgggtggcggcttgcacatggaaggagcaggtgccatggtagccaccctgccctgctcctagctgcggcccagtgttaccacttacagcgacgacaagcctagatccaaggtagtcctggggccaaaccccgcccaggagcagtctcctggctcaccttggcctcatcattccgaaggccatcactgccaccatgctgttcaggaacatggtaggataaggtgacgaggcttggaggcctttgggtgtccacttgagttcacgtggggaactctgggctccaggatcgctcttcagagatctgaacacctgtgttttctttgaagcaccaaaactcttcctactgtggaccatgagtttattaacccattgccctaggctgacagaagagccctcggagcaatcttggaagcaccccctggcctcagtgctcgctgtt

SEQ ID NO: 10572 - DNA, 1189 bp, Homo sapiens
gccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcct

SEQ ID NO: 10573 - DNA, 1189 bp, Homo sapiens; identical to SEQ ID NO: 10572

SEQ ID NO: 10574 - DNA, 1242 bp, Homo sapiens
gtctggtcaaaatgccacagaaaatgagctgctctgccagcaagctgtggagctgcctcctctccaggcctggcatcccttggtcagcccctcctgggagggcacagccgtattacagtgccagtgtgcctggccatcagcatcttcacccttcccagtctgtgtggggaggctgtaaaccccgtggattcagctccgtgtggagtttctgtgctatggtgggactgctcattttgccccatcatccctttggcctcccacacacctgccccttcccagggatcacgtgtgtctccagcctttcacctttctattgcaatggtggcctttgtccaggcaagagcaggcctgatggatgtactggtgagccccacagttggatgtcagctcagccgtccaactgggaggaacagtaggctcagttcctccctgacccctgacaccaggccgcagtgggcatgcacaggcccacagaaagtcagtctgggttttgcttttctcgtgagcatcacagttaaagaagcgctcattgagcaactacagtgcacttggtcttctgcaagtgctgggcacctagagataggaacagtcatggtccctgctcttaaggaactgatgacctggtggggccctgttgtcttcaaggaacccagaagccactgggccccaaaggtggaactgaaggactgggggcagctggctctcagcctgccacctctgcactgcctgcctttaaagaaccccaccccaccccatgatggccccctctgttccccttgtatttcagtgactgtgaattgaggttaggaaggcacacctgcccttctgtgtgctctctccacacgaaggatgacagatactgtgaattcagccctcacggccaactgtgaaggggatggagaaggctgggagggctcggggagagctcttaggggctgcggaagtccccacgggggtctgagagtggagcccaagctttggccctccaggcatccccagtttccagcctcacctctgaagccctgctgcctttaaccaccagagccgcagccccctgggtttctgtctaactcgaagtcttgaatcctagctagtttggggttgtgagcagtgtgtagcaaagttgatctctccatgtcaccaaatcaaaacaccctctgtcatcctacggcatttcctcttgaggtcacagagaggaatggcaagccctggaaacctgtgttattctgtgttgatttggtg

SEQ ID NO: 10575 - DNA, 2485 bp, Homo sapiens
catcccttaaggttattttcctgattgattattgaaattattacttgtaatacctacatttactttacactttgaagtaggcactgtggaaaatacttcacatctattatcatttattcatcccagtatcctatgaggtaaacagcattatttctttccaaatgagaagagattaaggcacttgctcagggccatacaactagtaaatgacatgtggttttcaagcctacatattagccactataccagattgcctctccatagataacaggtccataaacaagcaacttagaataaattcaacttcaaagaaacaaataaaaatccagaagtggaattaattttttcagaggaagagaggaaaacaggaagtagtgaattacccttttgtccattgtgacattacaactaatttctccatctctgttttcttccagttccactgttgctcagccatctgagatgcccccatctcctctggtgtgggagtgatggtggaagataatgtactactgaagatgtaatgtagctttccactggagtctgggatttgcaattctggaggttaatcatgcttgtactgtaattttactaatgaagttttaaattaacaaccactacttgtatgatatgaataatatttagaaatgttactagacttttaatcttgtaaagtggttgtgcttttagaagaaaaatattttacccagagttgcacatgttttatgaatttagtgcagctgttatggctcacctcagaacaaaagagaattgaaccaaatttgggagtttggggttttatgttttgtttttcttttctaaaatgaagtgagattgttcacacacacacacacacacacacacacacacaaacacaaaggacagtcatacattttgatatttgagccattcctaaagatttggggttttctaaaactaaagaatctaggaaccttgcctgcgaccaatcatggagccacgtgagctgatcgtggctgcacctggggggagggtagggaggaggggcatgccacctaatgatcaagccctataattagcttctcattagagccgtgatggtgatgtgtgctgtctaaaatccaatgttgtgggtagagagaatgagtttgtgactaggagagactaaacttttgttttccttacccagtataaatatatatatatatatttaatctatttttattagaagtttttctgctctttcttacataaaagaaccccaagcatgcatctttcatgtgtgtaaataattcatttctgggctaatttcaaaagaatcccaatattgctgtatagaaagagaactagcttgcacattttaggtctgtgaaattttgtgagacttttcctgcactggacagtaaaaaaataataaaagacaaaaacaaatttaaaaaaaaatttaagccacaaaaaaaggcacatagggaattatgtcaaatgtgtttgtgtccttaggcaaagctgtgggagtcttgaaatgtcacagtagtaaataacttattactttttgacaagttctttttttctgttggaacactgaattcttctgtgcatatgtacatatgaatacaaatcgaaggcctctacctcctggagttatacaacttggcttgtttacctccacatgctgatgatgactattttttttttttgagttcagtgtggagacttgaaacttgaatgtcccttccaacttttatattaaaaataaaaagacaagaaaattgaagatcatttttcacctgtacaaggaatactaatggatcgtcttaaaattggtctaggaaaaaaccttggtgtgtgttatggacaattaactgttaaagttattgtaagttatctgtatttagcagagtattttcaacttgagtgatctgagctgaatttgaagactattaataagttatgtttggaagttttaacttcaatgaagtaattatttgctgtgaaagaaacaaacattgaattactaaacaaagatggtgcaatatctttgttttttttttatgaggctcctgagaatcaacccaactgaagcatttcaattcacttgaatgagaaacgtgtttagtatcaaaagagcccaagaagacactggtgtgaaaggtacaatctcagaggttggtcaattaccgtggcacactttctggtcactttgtacaatgtagatttgaagtacagtggtgaaaacattaaatgtgacatttgaaaaagatgtgtcatctgttttatttcagtttctttcctttgttttctcttcagtacagctcgtatcctgactttgcaaagttttgagacacttcctatttatatttccactttgatctttgaggaaattggttgtttttaaaaatcttctcaaaaactttagattgacaaaaacatattgaaaatttagttaaatcaatatcaaagatgtgatttaaatatacacaatagagaagtctttttagaccttgga

SEQ ID NO: 10576 - DNA, 1128 bp, Homo sapiens
catcctcctgcctcgggctcccaaagtgcagacattacaggcatgacccaccgtgcacagcgtcagctttatttttttaatgctgacttactgcagaaggcccaagggccagtgcagttttcatactgctgttgtagtggcgaacggagccacgagggaagggagcgccgccggcagctgccgggacaccaggataccacgcggccagcaccgaaacgctaggctcgcgctcacaaccgcaatctacactgagtagccgcgcgccgaacggcgtgactaagccccgcccacacggcgctcctggcggccaatggaaatggcttacgagacgccttctccacgcgctatacttatacggaccaatgggtgcgccctgtggggagtgccgccccctgtccacgagcctcctcttctcgccagccaatggaagcggtctgcctagccctcgcgggggcaaggcggcgaccgaggcgcgtgggtctgggaaggcgcgcggatttggcccctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgaggtgaggggcgcccctcttatcccggcccgctgaggctctcccggcgctgcgtccacagggccttcacctcctccgcgctcgcgcactctgggttccagttgcctctctcgggtcctgcccatgcctcccccgctcctaacccaactttagttcggtgttttcctcgggctttgtctctatcccagccccttctcccaagcggcgggggcgaacgctttgtttcctttaaagtcacttcttccctgggtttaaggtttcccgcgattccacctctggccggttgtcagtgtctgagggaagtagtctggatgaagtggtgtccaaagtcacatgttaggtttgctttaagcttctggttttttgtttgtttgtttggaagggctttaaaataccagtctgatcccaaagaaaaaatccgagtagaaatagacctgtctgaaggtttagcaccttggtt

SEQ ID NO: 10577 - DNA, 1832 bp, Homo sapiens
gcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgaccactgcctggtttgttttgtggactaggggatagagaatccagggttctctcatgaggagttaaacatatttcaagagcaacaggaaaaaaggtacatcaagccatttgaaaacaaaaatttattgcttctccttccaaagctttgtgaatttacaaaaaaaaggatgaaagtttacaaactgcttagttccaactaagcataagaggtgagaacgtacactgcagggccaccagcagcagctgtgcactgatgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattcattttgttctgcttctactttacacaaagcttcatattcaacccgatacctgaaaaacaaaattgttagaggccctgaaaaaaagatgaagtaaaccacagacctaattcttctagagaaggatatagaggtttaaatgatttcaagaaatggtgtgagttcagaatgaagaaagaaagaggcaaagccctacccagagccacccatgagaaatctccagccctaggaaagtcttctttcagagagccagccaacttcgtggaccctttcatgctcaaactactagaggtggtttgatattaacaagttttctatttccttcccatcaaatgtaattttatt

SEQ ID NO: 10578 - DNA, 2057 bp, Homo sapiens
tccgacagagcagctctggctttgcagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgattctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaatggtacagagccatgtttacagtgagcaggccttgaccagcttgcggccatgggctgagttcctgtgcttctgtttatcatctgaccttgtgttctagccaggtcgtaagcgcgactgtactgttgccctgcaaccccagctccccctggaggactaaggacaagaataacaagggctggaactgtgatttaatattaattcaagaaaactacctctaacaatcactgcagtggcggaggaaaagaaatcctaagaattggggcaagatgcagcacaattcatctctggctcttggaaatctgagagaagctcaggaagtagcttgacttagtcatcaatccatacctaaagctgctc

SEQ ID NO: 10579 - DNA, 2027 bp, Homo sapiens
ccattctcttgcctcagcctcccgagtagctgggattacaggcatgcgccaccacgcccggctaattttgtatttttagtggagacggggtttctccatgttggtcaggctggtctcaaactccccacctcaggtgacctcaggtgatctgctggcatcagcctcccaaaatgctgggatttcaggcgtgagccactgcagctgtgtttttcttttcatggataaccatgaggggctcttgggtctctggaccagtcatcctgtcatgagctagagatagaagagagctcaggctcacatgtcctctgtggctggcagctgagggcatggggccatccagatccttaggaggcctcagccctggctccttctaaaccagcttctttctgactgtaggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgttattcttgtccttagtcctccagggggagctggggttgcagggcaacagtacagtcgcgcttacgacctggctagaacacaaggtcagatgataaacagaagcacaggaactcagcccatggccgcaagctggtcaaggcctgctcactgtaaacatggctctgtaccattgagtttaacacaattttattagaaattagtgtttgcttccatcacttatgctgagcaaccaaatattacagttatgtgataaaggaaaaattctttcctgcccaggacctgcgccatcctttaggccgaccttggtcacataccaaattcaataaaacccaatactggcctgtgttgttaacagcaggctgccaggtttctcagaaactgacaagaaaatctgaccttcatccatactttgtttacttacccctgggctgcttggagttgaaaaatgcacacagccaagagttgctttctgaatagggctggaaactttcaaagaaaacccccaaacttttaagtcacaaagtctgattaaagaagctaagatcatgtcagtgagttcaatgttagtattttcctta

SEQ ID NO: 10580 - DNA, 1222 bp, Homo sapiens
aataaaattgacttcagtgtggtaaactctggatgtgtggttctttttctatatcagctttgttctgggtccactgggatagatttaggcccttctaggatattgtaggtaaggaagactttttgtttgttcaacattttatttttctgtgtgcctacaatggactaggcattgtgcattagggttaaatcagaaagcaaagtagacatgattcctgctattgtggagtttctagtctagaaaagaacgatttgcaaatggccaatagctgtacattgtgctaagtggaagggaggtcagggaaggcttcctggaggcctaagcttttacctaaaggatgagtagagtcagccaggtaaagaagaaataagagtgttccagcattggtctggttgatcacagacttcaagggaagaggtagcaagaccttgtgctggagttgcctccacctgtgttgctttgtggtctggggcccacctggatggatttgctggactgcagactcactgaggcccctctttccttccagcttttccttcatagcatttttggctaccgaggtgtcgtcctgtttccctggcaggccagactgtatgaccgggatgtggcttctgcagctccagaaaagtaagtttccctgtggttgtgcctcacagtatcctcaggaggagatggcagacatatgtaattggggtactaggggtgaagacagcgtcctcctaggccttggaaacatccccagagtacttctctgggactaagacccatggagacaaaagtgctgagtgccagggatagtctaagtcagagagtccctttaggcctcctcagaatgctttcctaagccattcctaattttcattatgagtatcccagagggcatttgggggacaagtcttcttgatttcttgatgttcagctggagtctttccctcaatctcacatcatccctagaatacattaaaacagaaaaggttcagccccattaagtgatcacagacagtccctgggatataagaagacaagagtactctgggccctggggactgaggtggcaatttgattttctcaacatggcccccttcttttaagaggtatccacacggtcagatgatggctccataccatggtcttccatgctctattatttgccccaactgaggagcagctgagctgaggtgctgcagagcaggtgtccagctggtgctaaagcccctttaga

SEQ ID NO: 10581 - DNA, 1265 bp, Homo sapiens
agttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtaggtggcattttacagtgtttccagtaacctgagctatataaaatttgtgttaaaaagctacactgggccaggtgaggtggctcacacctgtaatcgtagcattttgggaggctgaggcaggcggatcacttgaggttgggagtttaagaccagcatggccaatatagcgaaaccccatctttactaaaaatacaaaaaaattagccaggcgtggtggtacatgcctgtaatcccagcactttgggagaccaaggtgggaggatgcttgagttcaggagtttgagaccagcctgggcaacatggca

SEQ ID NO: 10582 - DNA, 1240 bp, Homo sapiens
ttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaaaggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatcc

SEQ ID NO: 10583 - DNA, 1163 bp, Homo sapiens
taccaaacgaaagtttaaatagaaaacaaagagagaaagagtcctcaaaagagctgggcatgtgtcatctaaggacacaatcgacagaataaaaaggcaacctacagaatggaagaaaatatttgtaaaccatacgtctgagaaggggttaatatccagaatatataaagaactcttacaatccaacaacaacaaaaaacaagtaacccaatttaaaaattagcagacggtttcaatagacattctccaaagaagatatacaagtggacaagtatatgaaaagttgctcaacaccactaatcactaaggaaatgcaagtctaaaccacaacgaaatatcttctctgcaacattccaattttaatatgtgggctgccgaagcaagcacaaaaccacaatgaaacaccacacacccactaggatggctgctgttttaaaaaagacaaaacactcttcctaagccggcgctcggcaagttctcccaggagaaagccatgttcagttcgagcgccaagattgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcagaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatcctcgaggacttggtcttcccaagcgaaattgtggtcaagagaatccgcgtcaaactagatggcagccggctcataaaggctcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaaaaaataatgagtattgttgaggctgtgaggaaatcggaacc

SEQ ID NO: 10584 - DNA, 1266 bp, Homo sapiens
gtggcgggactcaagctcctgacctttgcccggcctggctgggcctctcttgcagtcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttctctggtgtggccagcctctgtgtgtatgggcaaagaagggagcagggataggcaggaatgtgcttaaggcagtaaaaatttctcctacctcccacattccagtgcactctcaccccttagtcttcctgtcccctgattctctgtaccctgacaccatatagagtcagcatttagaacatgatggagctggagagggtctttcttgtgatgaaggagacccagaccctgagaggggaagctttggcccaaagtcagagccaaccctggcagaacagaggccgaaacaaaggccctgaactccagggtgcaaggggaaggtgtggggggtgggggtttggccttgtcctccacgctaccttccctgaaccccagaggccactaggaccactgggttgtgtttttagccctcatgatagacggtggcagggctttggctaaggcctggagccatctccttgccctcagctgccttggggagcccccatgcctgggtagccctgcacataac

SEQ ID NO: 10585 - DNA, 1242 bp, Homo sapiens
ggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgatacaaagtctgagctctactctttctgcattcacgcgtaagtaacagtttcctggtgtttgtcctcctgtgcccacaggtccactttgcttccacgtggccatgtgcccttcctagctggattgcccaaggctgttagcatctgctttttacctgagatactaattc

SEQ ID NO: 10586 - DNA, 1223 bp, Homo sapiens
ttgtataaacataaacataatttacccattctattgctaatggacatttggattatttctaggttttactgttagaaataatgctattatgaatacttgtttctttgccatgtgccatttttatatcagactctccagttgtctgtttattccgcttttcttgctcagcatgccatctctgagtttccatttcaccattttaccagcccctgaagagttagatgctgcctggacccatgtcaactgggaaaaagaagagaacggagacaaatgaaaatactcaatatatactcatagctcagaaatgctgagttaatagctcatgaatctcaagagaggtgcaaacctgttggtcattggcaaaggggcagattcggaacagtaggagccagggtgctttttggctttcttttctgagccatgggcattctgtctcttgctcacccccacaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggtagggcaccaggctctgccacatgaagggagaggaaatgaattacatggggcaggagggaaatctgcatgccaacttctttctcctttcttctctagtctcaatttttttcttatttattttatgttattattattattattattttttttagttatttattttgagacggagtctcactctgttgcctgggctgagtgcagtggcactatctcggctcactgcaagctccgcctcccgggttcacgccattctcctgcctcagcctcccaagtagctgggaccacaggtgcccgccaccactcctggctaatttttttgtatttttagtagagacggggtttcactgtgttagccaggatggtctcgatctcctgacctcgtgatctgcccgcctcggcttcccaaagtgctgggattacaagtgtgagccaccacacctggcctatttattttattttattttttgagacagagtcttgctctgttgcccagactggagtgcagtggcgtgatcttggctcaccacaacctctgcttcccacgttcaagtgattctcact

SEQ ID NO: 10587 - DNA, 1700 bp, Homo sapiens
tcccgccagggctcatggctgtttggctaatggggctggcaggcagatcctcttttcaggagcctttcattttagaatccatgaataaatatccttgggaaggggcaggtgcatgaagtgagtggcttctatgcctaccctctccatgacctcactcagattattaaattcagtgtttactgagtgtttcgtatagcaccattgattttagggaactgagagctaacacaacctaaagtttagaaggggttataattagactgtaagcttcttgaaagcagagaccattgtatgtgaattgccccattgtgccttggatgtgtttaataaatctttattgtcttggttcattttgatttattctgcctgcccactaatatttacattttcttttactcctctccaatctgccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcatttttgtgtgtgtgtgttgagtgcatgcattcaatctgtgtattcctccctcatcaacccagaacatcctgcagctgccactctgagggtggccccttccttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaaggtaggctgtggggctctggcagcctactgaggggaggagagggagacatgggcttgagtcctgggaagttcctggttaggagcatggaagtgattacccaatgtgggggtggggcagggaggctgt

SEQ ID NO: 10588 - DNA, 1700 bp, Homo sapiens; identical to SEQ ID NO: 10587

SEQ ID NO: 10589 - DNA, 1183 bp, Homo sapiens
gtcttttttcccctttcctagtccatttgcatgtttttagcacggggcatttataacggcccttcagtataaatccactatggaaaacaatgtggtgatctgagagggtgaaagcttgcccagcttagcagtaccattgcttctcctctcattctgcagaggatttgtgggttgctttatggcaggaaggacattgggttgggctcttctttactctctatcctacaggtagtactgcggccccagagctcctgccagtctgggcgacagctagctctccgcctcttcagcaaagttcggccccctgttgggggtatctctgttaaggagcattttgaggttagtaagcagtcccttagggacctgggaacaagggacattcaaaagccacctgtgtgttacacgatattaggagtaggtaaactgatgatggtatctgagcttaattgcttcttgaatctttttcctttttaggtaaatgtggtgcctctcaccatccagctgacacaccagttcttccacagaatgatgggctttttctttcctggccgaagtgtggaagatgatgaagttggtgatgaagaggataagtccaaactggtgactactggtgagaacttttatggtggagccccagaagaatagggtagcaaccccaaagacagctgagacttcagaacgaggatggatgacagctggtacacttgctttttcataggaataccagtggtgaagcctcggcagctgattgcaacagatgatgcagtaccactgggccctgggaagggtgtggcacagggtttgactcggagttctggggtcagaaggtcatttcgcaaatcgccagaggtaccaaacatgcccctgatgatagaaaaatgggagagtcttgaggtcctgtttggtgtggcttgggatttcttcggtttcctctaagtccattctagggataaaagaagagggagatgtttggggtcctgagtttcttctgatggattcagggctcacactccttgcctgcctttcttagcaccctgtggatgacattgacaagatgaaagagcgagctgccatgaacaactccttcatctacataaagattccacaggttccactgtgtgtcagctacaaggtctgcacctctcaagcactttgtagaacagggtgggaagggaaccagata

SEQ ID NO: 10590 - DNA, 1176 bp, Homo sapiens
cctcctgccttggcctcccaaagtgctgggattacaggcgtgagctgggattaccacacccagctgaaagatcactttggtggccttgatactatgcatctgaactgaaaatatctttttttttttaatgaacctgacataaacatatgaaaatgtcttgaagttgatcagtatacagttgcagataaaattgtaggaattattagtgggaagacactactttatcaagaagctatagagctgaaagatgggatttgtgctcctatgacctagaatgtcaggagcaataaattcagtgaaaaaaatgtagggactggctaacccagaataggttaatttctgggtttacctcctgcatcattctagagcattctatcccacccccaacccatgtgctgtttcccttactggctttggctcccctgtccacttacaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtatctggggtatatggtcacacaaaggcagctgtattgagagacattgacctagcttaggagtctaactcataaaagagaaataaaagggggttaattattgtatgattattaatgatagtatcattaatattaacgagctcattaatcatattaatgagcagagcttccttagatatatctgtttataatgaatgatacacatatagctctgatgccatagggggagagtaagaatgaacaaagaaataaaataatttttaaaaaatgatacaggccacgtgtagtggttcatgcctgtaatcccataactttgggaggctgaggtgggaggattgcttaaagtcaagagttcaacaaaaattttaaaaattagctgggcatcgtggtgcatacctgtggtcccagctacttgggaggctgaggcaggaggattgcttgagccctggagttcgagcctgcagtgagctgtgatcacaccactgcactccagcctgggcaacagagtgagaccctgtctctaaaaaagaaaataaataattaaaaacatatatgatag

SEQ ID NO: 10591 - DNA, 1095 bp, Homo sapiens
tgaactagcaactcagattaagccacctgaagttcttgagaaccaggaaaaggaagatctcctaaagaagcaggaaggtattcagggcttgaaaggcttttaggaagggactagagaaattgtgaaagtagttatttccttggtggttttgagacagtagagttattaaaaatccactgtgcactggcattaacatttcactttgctctactttttgtaagttctgctatgagaaaataacctctattcttggagggagctgggatgaatgggcattgtttatgattctgaagtaaacatgtttctgcccatgagcaactctcaccctttctgtggggttgactagtggggtggttccaaatgtgggttaagagatggagtagatatttaggtagaaacttgagccttttatttagctgctaacaattatctaggggctgtggataccttcacccttatccaccatgagctggaaatttccaccaacccagctcagtatgccatgatcctggacattgtcaacaacctgctgctccatgtagaacctaagcggaaggtgagcatgggcccttgtagaatgctggttagcctcacaggaacacccagactttgtgctttatttgggcttctgtaacaaaagccatgcttcacactgaaaaagggccttgtggttggtagattctcttagtcggcagtgacaattgaaattccacttacttaggaaaggcctgaatatctctcagaccgtagggcttgtttgcctgattgttttctcctagtcatttctctactcagtcacctagacacctctaaaaacatttactattccctgcttccacctccatcccatcctgttgggcctgacctattgtgaaatccacattgccacattttctgcattgacctactactgttgctattaccagtgacagataaaggttagctttctagaagagaccccccccatttctttctcctttctctatttcactttactacaagacttgtctacttaaaaatcatattcatttccctttccattcctttaggaacatagtgagaagaagcaacgggtcaggttccagcttgagatct

SEQ ID NO: 10592 - DNA, 1099 bp, Homo sapiens
atggatctgaggagcttagacctgggagaaggaagagggcctggagacataatcaggggaagcagcagacctcagagaatataatgacattgatggcaagagagtggtttcaagtggaaaagagtggtcaaataacatgtaaaataatatgaaatgaaaaaagaaataaaatgggggtaagggagagatcatagagtaatacctaagagaaaaaaatgttacctagcatttctaagtttctgttgggaatctgttacttttattaaaattgaagggaaagtgaaataacccttgttttgccttcatgggtcaagggatgggctgggctagagttttaggtttgggaggatgtattctaagctcttacctagccagataaattgagggaagatcaatttggctctggaaagggaaaagtctttccctttgagactgtgacctttccctgcttcctatttctctgccaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcaggtaccttctctttacaagttacctcaacatcaggctagatcatgatcatattgttccccttcccccacctctaaatatgaatgggtgaatagagctccaaaaaatttggccttctcataggtatcataggtaatcacttctatgtctaaaagccagtaaaatttacttggtaagccagcattagacctagctgcagtggttgatacaatgtgctcactaacctcatcgtccttggtagcttaactctgcttctatctctggcatagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagagg

SEQ ID NO: 10593 - DNA, 1135 bp, Homo sapiens
gtaggtatagtttgaatgtaatataatataaaagccaagaccacttagtttttcttctccagggtctgtctccccaccacgcccagtgaatttttttttttttttgagactgcgtctctctctgtcgcctgggctagagtgcagtggtgtgatctcggctcactgcaacctccacctgccaggttcaagcgattctcctgcctcagcttcctgagtagctgggattaccagtgccagccaccatgcccagctaattttttgtatttttagtagagatggggtttcaccaggttggccaggctggtcccaaactcctgatctcgtgatttgcccacttcggcctcccaaagtgctgggattacgggcatgagccatggcatctggccaacaggtttcttattcaacaaacttttatcactgcctctgtggcactgggggcaatttccatgctaccctgaagtccttttcctgtttcttaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtaagctcggggagatgagactttttgggtttgggtttagaacatggatatgggcttggacaggagttttaaaaggactgagtcatggtgcttctatctaggtaaagaagtgaaactattatttttccttcttaggccacctaagtcttacatattaagtaacagtgatgttggggcattaaatggtctggtcctatggccagaagagaatcagaaggggagtgttggagccaaaacaagatgagtaagggaaagaagcaaagtggtaaatgccataagagagaaataaaagaaaatgggagttggatgggcacagtggctcactcctgtaattccagcacttttggaggccgaggtgggt

SEQ ID NO: 10594 - DNA, 3499 bp, Homo sapiens
ttcagacaatttagaatccagttgaagagaacttaaaaagtataagtgctcttaaatgtcagacactatcaactgtcagctcagcacattagtgctaacaggaacaaagcaaggcagtaattaatgtgattactcaggaacaacttctgggtggagatggttcttgagccaggtgtgcatgtgtcataatccttgccatctctactgttttgtgacatggtaattgacagatccttttcttctgctccctaaaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctgggtaagtagtgtttcctttatttgcagaccccgtgtttgcccgctgagctctggggagctctcagtgatttcagaggaactaggttatattgggaactgtgccgttttgggtgggtggagtgggatgggtgggcttcccttccctttctttgttcctgaatttcaccgtgaaattgcttggctaacataaagggaaagctaacacagtcatctttaaggttattgtgtctcttggatctcagtgctatgcccttaaccacctgctccagggtcactgtcatttttcagcttgctgtgtcaactgcctgcccttgttctctcaattgactttgtaaatatagatgggtaaaatagtggtgaggaaaaagataggcccgagagtgctcagactgcccctgagtagccagtgtgtacccttcctctggtaacagttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactgtgagtagagatgaggcagttggtttggctgagggacgtttgtgatgggtgaaatgggaggtgagctgagacccttctggagtgaaggaggaagagaggggtaatgttgtgaacaagttatagcctttgttcctctaccccagcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggtgaggggtgtcatgatacttttatcctatcaggatggtatggttgaggtctgtatagcacatgtgggaagagagacaggtgctgatttgggagatgaggatggttttcttacctatatctcaccaaattctcgggggtggtcataggatccatacaacacaactgaaaatatgcactgggagtggagccacctgtcttttcattggaaacctggtcagtttgtgttcaagggtgacttggatatcaacgtgagaacagcctctaagtgagtggagtgaagggagggtcctccatgggatgaggggctcaggttggagggagggggaagagccaaggggaagtgagtgaccagggcactgagggctggggttccattgtgaggcaggtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaagtgaggcttgggcctggggcagtggggaggaagggcttgggaggacgggcatggatgctggggactttagcttgaccctctggggaggggaggggaggggagaagggcaagggagaatctaggttaggacctttttttttgttttttggcaggggaaagggttggtgtcttagtcctttttggctgctataacagtaataccacaagtttggtagcttataaacaacaagcgtttatctctcacagttctggaggcttgaaagtcgaagatcaaaaagagctgatagattcagtgtcagtgagggcccattcctcatagatggtgcctttttgctgtgtcctaatatggtggaaggagtcagtgagctcccttggaccacttttaaaagggcactaatcctattcatgaaggctccaccgtcatgatctagtgacctcccagaggcccacctcttaacatcattaccttaggggtatttcagcatgaattttggggagatgcaaacatttagaccatagcagtaggggaaagcagagagcttagatccttgaaagaagagggagttggggatgctga

SEQ ID NO: 10595 - DNA, 1627 bp, Homo sapiens
ttatggtttagaagtgatgcttcttggttattttaggttcaagcgtatagtattgctggtgttcattgtatttggcctatgaaaatgataattttatatgagtcaacctaatatccttttggggttcctgcagattaccattaagagtagcaataaactgatgagttcagccttttatcttctaggtgtgtctcgtcctaagaatcacaataaaactctgaattctcactctgattgtgagagcttcagaaactgttccatgataggaagctgcagttcttttcttaccaaacaatgatgtcttgttcctatgcagaaccttcccccaaatcctggctcccatcatctttagcacctccatctccaatgtcaacatttccattcaacttggagatacaccaccttttgccttgggattcaattctatctctctgggtaaggctctcagatggaataggaacaagaatctgtccgttagtggagctaggcccaattgatggccacagtggctccatgcaatccctctttctcacctttgttcagattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacaggtaggtgagggctttggtgaataggggcctgcacagctttcctcatcctgtcatgcgtcagagcgctgagcatcctaatgcagcaggaagtgcattagggcattataaaactgtgcgcctgcatacttctaatgggatccgtctgcttcttctctagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtaagtgggacaaggagtctatactgaagtgtgctacttgggagactgaggcaggagaatcacttcaacccaggaggcagagtttgcagtgagctgagatggtgccactgcactcgagcctgggcaaacgagcgagactctgtctccaaaaaataaaataaaataagtaaataaatatactgaagtgtgtagtgtgtaaccttagcagattatgttggtttagtctgctcctcatttaatgaagctgattatctggaatttttctaaattagaggcacgagatgcttgaaagtcttgcataaatattagacttcttggtatttcttaagggcttatgaaaggcaagtactaagcaagacatataagaaaaagccttgatctagtcaagagagatccatataactttttatttccttgtgtgtttagttctagagagtaaatggtatgtctctgtgcaatttgtaggagttaaggaacaactttgattctgccgaatctagttag

SEQ ID NO: 10596 - DNA, 1190 bp, Homo sapiens
cagagtcttgctctgttgcctaggctggagtgcagtggtgcggtcttggctcactgcaagctccgcctcctgggttcagaccattctcctgcctcagcctcccgagtagctgggactacaggcggccgccaccgcgcctggctaattttttgtatttttagtagagatgaggtttcaccgtgttagtcaggatggtcttgatctcctgacctcatgatcctcccaccttggcctcccaaagtgctggggttacaggcgtgagccaccgcgcccggcaaggccaagtgctcttaatttttttcctttcccaggctaatctgtgaggtgagcttatgtaagatcaacagcaaagttctaaagagtggtcagctggtaagtatgccatgatcattcagatgcctcatttcctcctgggcgtaaagtgtgaaggagcttagggcttacatcctaggttctttgaccttagggggttccctcaagtcagtacccagtgttccagatcaccacattttgacctaaaacttccaaactttcttacatacaccttagaggcttatcatccccacaggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcaggtaaagccccagtgattgagcttcttggctgccttgttctcagggtttgttttggaagtagaaaaaatagtggtctcactgcttatttagatgtgattcactagtcaccatggactttgaccctaaggatagttagaggaaatagggcatttgcttgtgctgagtggcagaaccagcattgagtgggcacctatcatgagttagacctgtactatgggttttttttttttcctttttttttaaaaaaaaagatggagtcttgctctgtcacccaggctggagtgcaatggcgtgatctcggctcactgcaacctttaaccttctgggttcaagtgattctcctgcctcagcctcctgagtagctgggattacagtcatccgccaccatgcctggctaatttttgtatttttagtagagacgggatttcgccg

SEQ ID NO: 10597 - DNA, 1465 bp, Homo sapiens
cttagcagaggcaggtgctctggatcctctgagggccctgaccacatgatatgccaggaacactagtttctgggtgaagacggaagagggcagtatggcagccagctgctgctgtatctgccttatcccagtagaggggctgctgcccataggtatgaggttcctttctgcaagggtacagtgattggtgggaagacttccttctagcaaagtcccaatctcaacttttcttcccctcccaggtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgagctcttgccaaagcctctctctccaactctccagctctttgaggggtggctttcaaagcagtgtttggagctccaaggactcccctgactccctcttctgatccatcagaggcaaagattcatagactagaggcagcttctacatcagactgcctggggcacatccctgctctacttcccagccgggtgaccctgtgccagttcctgctgcctttcagctggctttcttacctgtaacatggagatagtgatacctgcctcatcagctgctgtgaggaccaaggcagcgtgtgcaagctccttggcccaacgcctggtacgtcgcaaatgttacccggtattattacacccactcactcacccacagcacagctgccccatccgcccatgcctgctggtcttctctggcaccctggagaaaggccacaag

SEQ ID NO: 10598 - DNA, 1152 bp, Homo sapiens
gctgtgccctgtgtccccagacccagcactgcccctgagcacctatctgctctctgtgtcaggtgagaatgtccgagaattcttcttccgtgtggcagcactgacctttgaggccaatgtgctggctgagctggagaaatcgggggctcgacgcattggggatgttgtccgtgagtgcttgcctggttgagggtggcagagggcacagtgagcctccaatccctgcttcacatattttccacccttctttaggcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcactttggggctggagttctttgttggggatgatggatgtggaatgggcatgactgtgtggccattttggcactagagtcccctggggatgctgtgctggccatccctggcccctgggcaggttcaggtaggctgggagctgaaacatcagtttgggggctgcactgggccctcactgggtgaagtctgaatggctggctttgagagccctttcccctgatcctttccccacacgtgtcctcctacttggtgcttatacccaaattttcaccactggagaatctttttctttttttcacccttttcttgccttccctttaagaagtacttttccaggcagggtgcggtggctcgtgcctgtaatctcagcactttgggaggccaaggcaggcagatcacttggattcaggagttcgagaccagcctggccaacatggtgaaacccgcgtcaccattaaaatccaaaaattaggcc

SEQ ID NO: 10599 - DNA, 1746 bp, Homo sapiens
ttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccagagggcgccgctctgcaaattacccaatcagctctaagtacaaagcatcgcgagtctttagtgctctttggcgctataagcccgtgggaacgagcattggagacccttttcacaagatggcgccgaaagcgaagaaggaaggtgtgtgttggtgatggggccgcagctggtttaccggggattgccgcgccgcagagcgaacgaattgggaacacggctgctgggctaagccctgagggctctgctccggggctgctccctgcgtttcggacacgctgcagtatacgtgggccgcgtgggcccagcctcgtgggctgagttccggtagagggagttgggggggggcaacgcggcaggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatggggtatgtgtaaaattcgtaggacattttctggaaagtatcaagcgttcattcagtgctactttgtttcatagtcgtatccctggagttacttagagttggtcgctttcgcctctggtatcgtgcatatgatggaaaagttttaatctcctgacacttgtgatgtcttcaaaggaaccactgatgcacctgtggccagggtggcccactgcagttcttggggccggaagtgaccgatttctaaatcccgcacccacgttttctttccttttctcccagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagtcagtactgccccctgtacccatgaaaagatttgggtattctccattggtaatttggaaattcactcactctgcgtgatggtttctcaaacgcaaattgtgtccagtgtgcttctctaattggaagtatgaggagattgtttctgctgcatttacaaaactggcaggatcagcccagaggccgggcgcggtggctcacgtctgtaatcccagcactttgggaggccgagggggggcggatcacttgaggtcaggggttcgagaccagcctgagtgacatggagaaaccccgcgtctattaaaaatagaaaattcgccgggcatggtggcgcatgtctgt

SEQ ID NO: 10600 - DNA, 1746 bp, Homo sapiens; identical to SEQ ID NO: 10599

SEQ ID NO: 10601 - DNA, 1228 bp, Homo sapiens
ttcatccctggactcaagaggggcaaagagcccaagagaggctattacaggctccaaggtagagccagcccagttgggtctaggggtgggaactgggcactgcagtcagctctgaccctggccagttcccccatccctacccccagatctacccagacccggagctggaagtacaagtattgggcctgcctatccgctgcatccacagtgaggagggctgccgctggagtgggccactacgtcatctacaggtgaggctctgatgtgagggctggcaccacctctcccttggcaggcactaattgcagccttcccaccagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgaggtgggtggggtctggctgaatgtggaggagggggtacctgatggcctaggcatctcttaactcagcacctctgacatttccagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccaggtgaggccttccctgaactgtgggttgcagggtaggtgacaggtagtcaggatattgactcctgcctctctacttctgtggccccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacagggtgagatgccccttttcctgtcagcccccttttgcccttgaagccctagacagaggctcagcttctgatgtacttaggccttggtggtccctgctgtgctgctctgaaaccctcagtccttccctctgctgccagctccagcctcttcctaacaccctctgtcttcctcacgtagagctgggtgcctgctaccctgtacccactcctctcctctccctggacctccccctactgataactctcctcccttcccccatg

SEQ ID NO: 10602 - DNA, 1840 bp, Homo sapiens
tgcctgcctctgtgcatgccctcacaggcgtggacctgtctaaggtatgtgcctgcctagctgcggtggggttgcccaggtagcccgtcggactggcccaggcaaagtggtcctgggctctggagccaaggtctcatggcatctcccatccttgcagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacccctgcattgtgtcttctgtgaggagagagactgcgaaccgagaaccaaccaggtcccctacctctcttcagcttcaaggcagcttttagcctgttcttccgcattctagccactggggagcaacagcacactggccttgcccccagttgcgccttggacatgactgattggctaagatgcttaggccaaaccccagccctggaacacctggctccatcacaggcagaaggtggaggggactagcagggtgcagttgcacatgcctgtagtcccagctactcaggaggctgaggtgagagaattgcttgagcccaggagtttgagtccagcctgggcaacataggaagactccatctcttaaaaaaaaaaaagaagaaaaggtggaggaaactgccaggttcactgcacctctgtaccggt

SEQ ID NO: 10603 - DNA, 1196 bp, Homo sapiens
tgctgagggcctaggtgagggcttcctgccccgatccacctcttggcttcacagggcagtgaggttcagccatgctgtaggcctcggcgaggggttggctgagtaactcaagaaggagaggcaccctcggttgcatcccccaaccctctcctgccctgtccaggctctttccttctctgtctgtgtccctattgctcattctgcttctcatactctctgcccctcagcctgagggtctcccacgtgtaggaagcctgcaagggaggaattagctggtgaggggacagtaggctggaggggtggggagacaagccccgaatgcccaggagaggccgtggcagggcctggggctgtcagtgcaggagaagtttcatagtgagagaagcccttgtgctgctgtctccccactagaggcttcagacagattccagccccccagggcctccaggtctgaaaaaaggaagggaggaggcacagccaccatcctgcctacctctgggtctggggcctttgtctgcctcgctccagcctagctgaagcgcctttgtcgtcactgacaggtgaagatcatgacggagaaggaactcctggccgtggcttgtgagcagtttctgggtaagaatgtgcaggacatcaaaaacgtcgtcctgcagaccctggagggacatctgcgctccatcctcggtgaggccctgttcagcctttgaggagcctcacggggcccctaagccaaggcagggaggtgtgcagggctgggcagggggcctgtttcacaggagtttcaagctaaaacacttttcctcaaatatttaatttcaaaacttcaggtgacttgagttaaggagagggtatgagtgaaggggtgggatgggggctgtcggtctgctcaggaacctagtgctgcttgggacacttttcctcattcagcctggactgtgcagcaggaagctcggtgttaagtgctgttgagaagataccccaggaagacccagctcagagtgcagcaccccgcatgcacccctacctctacatgcatgcctcctcccttccccagctggctgggtccctggggagccagcccttgatccctctgcccccagggaccctgacagtggagcagatttatcaggaccgggaccagtttgccaagctggtgcgggaggtggcagcccctgatgttggccgcatgggcattg

SEQ ID NO: 10604 - DNA, 1232 bp, Homo sapiens
tgttgtttttttgttttgttgtgttctgttttgttttgtttgagatagagtctctctctgtcacccaggctggagtgcagtggcgccatcttggctcactgcaacctccggcctcctaggttcaagcaattctcctgcctcagcctcccgagtagctgggattacaggtgcccaccaccacgcccagctaattttttgtatttttagtagagacagggtttcaccatgttggtcaggctagtctcagtctcagtctcctgacctcaggcaatccgcccacctcggcctcccaaagtgcagggattataggcgtgagccatcgcaccagccccatccatctttctaatcataaatgtaactgaatcactggaggaagataggggagaatgttaggatcaaggaggggagaatgttaggatcaaggaggggaggctgttccacaggtcaaagttagtttgaattttccttttcttgccacagaaatggccaacatctcttttttgcaggagttgccgtgtggctcctctcatccagtgtgactattgccctctcctgtttcacatggattgcctcgagccgccgctcactgccatgcccctgggcagatggatgtgtccgaatcacatcgaacatgtggtggtaagcacagcagtgtccattcagtcctcaatgggcatagctggagcgtggactgattagcagaaagcatattaaggtcagcttggtgccaagttcaccacattgtcataggtactggtttctgcaggccaccctactcaattctgatcattttgacatatttcagctatgctttttctcacaatgttttgtttcagctgcccatacagacttaactcactagtgcttggttgtttgtaagtgacttatagggaattaagcagttgatgttatagccctaaaaggggagtatattagatccaaccttaaggaaataaatcgttggctgtctggggtacatgtgtcccaggcaccaaatgaagtttagtaaataagctgttgaatgaataatagtgtgaaggtcctattgctttctcttccaagagtcttgggtttattttccagactgaggctagaaaagagctgtcacttgctatctccaaaagaagtttaggacatctctttataggcagttagaacagtcactcacaagattgaatgggagaggatttgaggaggaggagctccctcataagagcagccttccaaattaa

SEQ ID NO: 10605 - DNA, 1181 bp, Homo sapiens
ttgtgtcaactttaacagaccagtgttccaagtgaccaggtagatgagtctgtgatatgtgaaggccttttacagttttgattagtggtctaccaggactttgtagcacccatctctttgtttcatggtacttttcatgatgggcccacctgttcatttgcacagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggtcagccaaaccatcatcatatcccttcccaaccccagtttccccaaaggaccagcacaagagcagtgctgcctgtggagtcactgttcatgtagctactgtcttgggttcctgttcctagttctgcttggagagatctttgaaggtcttagccattacagagcttactcagttttccattttctcagtttctgaacttctttccttcccctcccccagaattatctttttccttttttttttttttttttttttgtgagtctcactttgtcactcaggctagagtgcagtggcacgatctcggctcattgcaacctccgcctcccaggttcaggcgattctcgtgcttcagccttccaagtagctgggactacaggcgcatgctaccatgcctggctaatttttgtattttcagtagagacaggattttaccatgttgttcaggctggtcttgaactcctgacctcaggtgatctgcccacctcggcctcccgaagtgctgggattacaggtgcgagtcaccacgcccggccccagaattatcttttaaaaaaaaaaagtattatacattcacatggttcaaaaatcaaaaaatattaagggctacaatgaaaatttccct

SEQ ID NO: 10606 - DNA, 1223 bp, Homo sapiens
ccagcaggagaattcaggtttggtcctttttttttttttttttttttaatctcaggtcaaccaatcgagtggcggggtgaagtcgtccaaagtctttgaggtctaagagtcccagattcaagtttacatactggctgtgtggccttggggaagatcctttcatctctttggactggcttcctcgtaatatttcatagggttattgtgaagagtaagatagcctatctcacatgcctaggccgtgtcttacacataggagtactcagtgaccaaatcttgccctctgcatctctcactgccaccttgggaaaagctaagaaggtggttcttgccgcagaacgctgactcctcctattttggtttggggatagaactttaaaagggctagtaaacaaaggtcccttttcagcttaagtcagaattataggcagcagggaacatggaactcctgcttgcccaagttggaactctaggatctggaggcagggctgcagctccagggaccacgccgagtgtggggcatcagtaggagaggagccacactgggctgtgttttctccaatggtgttgaaacgagagtgcacttgaactgacggaggcagtggaggcaggaggagtacgggaaaggtggccccaaggctttgggagaaagaaaagagaaggtgaatggagctgtgagatgaggtcccctcttccctgttcagtgctgtgatcctgctccatcagggggaagaggcctcttcacatctgggatagctggaggcctccagagccagaggcctgatgaagactctgagttatgttattgtaccaagaaaggggcttttccccttgggccatcctaaaacaggtcttcccagcctctccttcctgagcctccatttcttgttagtagatgatggcatggtcaaagctgaaaattctcacaggcctcagggagccatcattaggggaaagggttcagatctgggagtatttgacagggaaagcgcctcctcctcagaaggaatctttttaggaatcactcgcctaagagagcccctaccctagacaagttgtactcaccagacctccagtctccaagccaatgtggttcacggactgcctgcttcagagccttctggggaaggactgaaaatgcagaattactgggttgtacccaaaagccagcgattcaaggtttctaagaggaagggcccaggaacctgcatcagattcttatg

SEQ ID NO: 10607 - DNA, 1188 bp, Homo sapiens
gagatcgcgccactgcactccagcctgggcgacagcgacactccgtctcaaaaaaaaaaaaaaaaaaaaagaatttattttctgcccaccccaaccccaggctggctgataatattttgatccccattttacatacaggaagggttaagtgggttgcctaaggtcacaaagctatcaagggacagaagaggccattggtctggtggacacaggacaggcccacaggacttgtctccttttctcttgggcctagtcccttcccgcacctctacccctcaggttcccttccgctcagagagttttgtggtttagactcataggatgttaaacacaaacggcccaatcctgcagcctggctcttttattttagggatatagaggctgggggaccagtccgaggtagaaccaggattacaagcagatgcggggttcttccctcacattcagcccctctctccaggtcattttttgctcagcatcccactgcctggcaggagattcattaggcttagagagatgctctctgcttggaatctgatgattgtttagtctctcctaattcagaactccagcaaagccatttacctctgagcacaggatctagcttttggggcttctgggttcagagtccctgcgggaagccctgctgacctgagaggactctacatgcagtgtcaataccgacaggcccaccaggctgtacccagaacactccctcagtcttggtgtagtaataatgataatagcacctttcatctttcagagtgcattcacattcattaccttattcatcctcagaagacccctgggggttaggtgttattctccccacattttacagaaaagcaagggaagcttcggggttgcttgcccaggtagccaatgaacggtggagccagagctcgaccccaggcctcctcacccagagctctgccacaccctccctctgcctggctgatgggcctgcctgctgtgtctttcttccccacctacctatccagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactgg

SEQ ID NO: 10608 - DNA, 1113 bp, Homo sapiens
gtcggggctggatgcccagggagtgggcagtcccagggaaaatgagagtctaagccaggagaccttcgcagacttgaggggtccttccctggggcctgaagggggcagagtgcacgcaggccagggcctggactgatagtgccaggatgatgggtcatttgttctgggcagaccttttctgccttctcattagcctcaaaggagctgccaggaagcagctgtcattcagctcagaggcccagggtctgcctgtactgcacacagccctttccctcatctccctggtccagagcgggacaggcagctccttgagcatcactagtcctgggacccaccccagcaggcaggctcagcccattatcatcttctctacaatgcccctgccattggaggcagctggagcccacaggcacactgggcctgaggccctctgatctgtctttgcctctctccagctggaggagcagctgagccgccttcagcgtgagaagaatgagatccagaaccggctggaggaagatcaggaagacatgaacgaattgatgaagaagcacaaggctgccgtggctcaggtacccctgccaggagtgcccgtcacactctgcaccgtcaccatccttgtggtcctcctcatgggtcccccgcacaaccgcttgttttgggaggtgatggagtgggaacctcggtcccctggtgttccagctgggctgggctggttgaatgcttatgggggatcctgcttctgatgctctcattcctttcccaggcttcccgggacctggctcagataaatgatctccaagctcagctagaagaagccaacaaagagaagcaggagctgcaggagaaggtgaggaccaggggctccctcaggagagagagagtgccagggtcactaggtgtgggaggaacccccaagttcacagtttagaaggcgcttttctctgccatcagtaatccacagagcagcgtaaatgaggagcaagagctaggcttggagccatgtcaccataacagacatttgggcttcccctgcctcatttcccatctgtattccctctccgatccttagctttctcctttctctctgaagggcaatctctgtgccaagca

SEQ ID NO: 10609 - DNA, 1214 bp, Homo sapiens
tactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttccctttt

SEQ ID NO: 10610 - DNA, 1083 bp, Homo sapiens
tttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatataggga

SEQ ID NO: 10611 - DNA, 2002 bp, Homo sapiens
aaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagttgatctgttttctgattattttgtgtaagcttctaaacaaacttcagctgtgattaatttagcacatttaaataacgtgttattgtttggtataaagaattttccttcaactcagagtattagtactgtagcataaaccaaatacagtctagaggggatttttaacatccctccattataaagactgaaaaaggggtgtgtgtgtgtgtgtgtgtttatgtatgtatgtatgtgtgtgtgaggaaaagatggagatattaaaaattagtaaatgaatgtgtataagacattagtattcagagaatgaacttgtatttattttgtgccatttgttttcattacacagaaaaaagtcaggtggtttaaatccttaaaagggtagtattgaaaaatggcactaagaatgaaattatgacctatttttttaatagctatgaagatactaattatgggtgaagatttctttttaaatctgttttgattattgtaggcttctgtgtcacataccactcttgtaggtgtcctcaataatccccttttcccacaaaatacacagggtgtattatctttctctttattcacccccactttgctgaactgaagttaattacatagcctttcttctaacctccttagtaatgaaccttcacataaagtgtatttacagcgtctgtggtagccagcccttcctcctctactttctaggaggggatagccaataactaggaatttaatgacagatttttttttctttgaaataaatggccagagtttctccattttagaattttgttgtcctccttaatcatctgcttacctagtcattactcaatctgcagaaacttcataaaggaaaagtgctgcattgtttttacaaataacagtttgtagggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaatttccaggtattattagtatagttatgccgctgggccacatcctcaacaacagctgatccctcttgtataaatatgttaactgtgcagaacagttatgttatgggacaaatataatggtcattatggtcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatg

SEQ ID NO: 10612 - DNA, 1365 bp, Homo sapiens
gaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatag

SEQ ID NO: 10613 - DNA, 1554 bp, Homo sapiens
aaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacacccatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaaggtaactcatttgtttcctatacaaagatttttattggccaatttagtatattgtttatattaagagaattttaagagaattagttgttcatattaagagtattttaagagaatgacaatgtggataagcagctggtgtcaaactaattcagggtccttggaacta

SEQ ID NO: 10614 - DNA, 1945 bp, Homo sapiens
aacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccaagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaatagccaattatttaaatgtttagttgccacagtgaaccaggagtcactgagccaatgactttaccagctgctgactaatcttcatcaccactgtagattttgctgcatgtgcaggtcctctatttttaattgctgttttcgttgctgcagtactttacaaacttctagttcgttgagacttagtgaccatttggcatcaagttaacatcacacaataggaaacaccacttccacaagtctcaagcctcagtgctaaagtactactgaaaaggaactaggaagtttggccaattaaaaaaaaaaagtaaaataagttatagtggtcagggaatctcttgacgaaagctaactcttatttttcagggggcacatgttttgttttgttatgttttgttgtacaatgaaggatgaacccaatgctaaaaagtcagttattttcttggttttccatttcttgtatataaattgtgttggaggtgggtaggaagctgtgagtatgacttgaagaaaaatatccttttcagtgacaaatcagagtttcttacaagttattgtcctgctcccttccaagttgtcttgaagaatccttgctgctaactctggatcctgcttttcctatagtcagagggctccaaggtagaactctctaagtccctctcaatggcactctttgcctagaccaaactaatgaccaaacagtaatcaatctatcactgttgaagtcctggttttctcaaccaaattttaagtctttcccaggtatgtcagtcgagt

SEQ ID NO: 10615 - DNA, 3246 bp, Homo sapiens
gggaagcagatcacttttgcatacaaaaactctttcaaacccaaaatattattggtggtacattttaaagtccaattgtggacttaaattagtcaaattgagagttactgagtccattcagatctccagtagggttttgtatctaatgtatttggccaccagttttacatgtaggtcatgactatacctggattttatcattaagttaactttaaagtatatacagtttgcaaaaaatgattcaaattaattggtttgtatatgtttgtgagatctagcttctgaggaatctcatacatagtaggaaccatcatagagtaaagcttgtagcagaaaaattggaagggttttgagatatcctagagaaagagcaagcactttctgaatcagtggggaaatatcaatatttgatcaaattaacactacctccttcccagtgttggtgttcactcactatatgtctttaagaaaattaaaactatggaaaatttgtctagcatatcagaagttgtaaatgctatatctggtatccagaggctggctgtaaaaagttccttggggtcactctatctcacattttttttggttagcattttaaaaatgcaaagccacatactttgaaatatattattccaaattgagctcccttccctttgcacatattttttcctccccttattgaagtcagctctaaccccaaattctagtatccaaaagtatttttatttgtataatgctatctgaaaaatgtgtttatattatattttcagagctgcaattcttattcgccatttcaatacctagagatagagagtcttgtatttgaagccacacacactggtgtaatatgcttagtactctaggtcaaggatttgttggtaaatggaacattttagcatagtcatgatttttggttgcctagacatcaggtaaacattcagtacactaaagaaactatcctggacactccctcctgcttccaccaatttttttctcacccccttttcaaaaattgaaaactctatgagtgtctttttgagaccataaagcagactttagtaactttctatttctgtaagtactaaatgtctggcattttaaacttttgtagaatacattatgttggacactggaataatactatttattttcacctgtgaaaaatgacttcattgtacttgaaacacctcctttgcatttctccatttgtgccattcactagtggaaataaattgtattataccatgatctactggctttttaaaactgtattaaatatgcacatttttggtatagctattatcatttgtatgtatatattgtatatacatatgagtgtctgtatgtgtgtatagatggatggatgtaactcatactgtacatttccatcagggcacttaaaagttctgttatttttgtttggttttgttatttcagtcctcagttaaggcaagaatgcatgtgtttcttaagaatgagtactctgcgttgatgtttatgagaaggtggtcattagatgcagtcttttcctttttaatcccctcttagcacttctgtgagtggagaggacattaagtaaaatttggaatcataagttgcaatgcagtaaaatggtgctggggaaggagccagttagtgtttctgtgagtttgtgttgtgatgcaataagagataagtaatgcagagagaaatgaaccatggaaagtaagaacactgatggtgattcctctgcaaagatgataagaaaaagaaccaataaatcacacaatctttatgtgctttctatatgtatttcttagtagtgataccattgatcctcttactttttttactccattaatactaataattatatactttgctgaggatcaaaacagccaagaaaggaattactgctaaagcatctaagattctcctgaactgtaaaatcaacaggaaatggccactgggagagaaggatttggtattgggtgaggggctttctccctttacctgcctcttcttgcttgctaatagtaagttctttgtgcaccttccaccacttctgagccactactattcaagtagagatttgccccaacacattaactttttccttggagatttatatggtcctgcattttgtcctgtgctcacaatgtgaagtgtcttctgtattcaaatcaaaaaataatatatttaaggtatataagtgtgaatctcctataatgatggaagaagaggttctcttgtcttagatagaaaagagccttctccaagagcaatgtcaaaacttgggctgtcatctttgagctgtttaccaaaatacagaccattattgaagaaaaacaaattatctattttgttttcccccatctaacatgatagtgcccccaaccaggttgtagcattgccttttaaaagagactcactcactcttagtttttaagaactggaaatttcccatcctcagatcccttaaaggatgaagagttggctgtacacttagcggacttgcctcttgtatgcaaggactactgattgaagtctgttttgctgtgtctggttatgttgtctgcacttttatgaaatcactacaataggtctgcattggaaatgactattaatttgtaaagaagtaagttttattaaacactgtctagaaaaagaaagtgaagctgagaactcttcctttattgtgcatttatattttctgctgaattccggtagttccctttaaagtcatgttgactaatgttttcctccttgtttgtattcagatttccaaaatttcactcatacaagggaagagactccatttagcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaag

SEQ ID NO: 10616 - DNA, 1224 bp, Homo sapiens
taattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttct

SEQ ID NO: 10617 - DNA, 2367 bp, Homo sapiens
ccagcacagaggatgtcatcttgaagacagagcaggtcaccaagaacattcaggaactgttgcgggcagcccaggagttcaagcatgacaggtactgagtggagggggaggtgagggggatgcagttcctgttggcttctagggtgttgcagagagcatgaggggccctgggttctgctgtccctgggaacctcccttgagagccccctgctttatagcctcccttctccccgcagcttcgtgccctgctcagagaagatccatttggctgtgaccgagatggcctccctcttcccaaaggtacaggggccaaagagaggaccaggagtgggagggcctcgagctggggcaggcgtggagaatcccatctgatcgctacctgggtggagacacagacaaactgggccctgatctcagctggtggcttaaagtccaaggtccagcctcactcctgccccctccagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatgagctgtttctgatgcttagagaatgggggctggagggaggtggcagacatgaagggtgactgcaagtgccccaggacccccgccctagggaagcccctgtgctgggaacgtctgtctagtggaagagttagtttgcgaataacaaagctaacatgtatgacgataacgccaccctcccacgagcacattcctaaagccccatgtccagggacaggttggccagcgggggcgggctgcctcaaacaccacctccatggcctaggacgagggtccgggtgggagtctctgtgcggcagatgcacaagctcaactccagagtctactaaaaataatttaattagaaacggagttttggcaagggaggcagaagcggctccttttctccccttggccgcccactcagcaaccaacaaggaggaaagcccccgcagtgctcggccagtgccgcgccatcgccaccaggg

SEQ ID NO: 10618 - DNA, 1258 bp, Homo sapiens
tgcatgtctcagaggtatatggtgcctgccggggcagcaggcctgaaggtggggtagggcggggaggcatttggtgtgcagcatctggggtgccatctccccgggatccctgcatgttggggaggttgctggcatgggcctggccacctctcaggtctctcctctcctcccaattcccatctccctctgccctcagccttgacttatccgaattggccaaagctgctaagaagaagctgcaggcggtaagtctgctccaacagtgccctgacacttgaagctggcccctctctgatcccccaccctctgctcttgcttcctctgcctctgactcgatgaccttttccaagtctttgacctgtcccctcactggcctcagcagtcccctctccctgacctccctacaaggggatggactggtcccttctctcccaccttggagtttggaacatgatccctttccactttcccattctgagactgtaggggctgggcagcacaaggaaggccaccggttccccaaggctcacaacatgctggggagctggccttggcactgggagccgatgcatctgacaacatctgggcccctctcttcctccagctcagcaaccggctttttgaggaactcgccatggacgtgtatgacgaggtggatcgaagagaaaatgatgcaggtgagtcagggagcaggagtgtctggcgtggaggacccgagcggcccaggcatgggtctctggtcctttactgggctaagaaggggtgcctggggttggggctgctcagaggcctgcagatgagcccctgctggctgtgagcctgcctgggcagcatcccaggctgggtagagtgctgagggggaggcggctagcgtgctcctcccccagcctcagactggggctcctcttgctctggcagcctcccactttggctgtctccctggtaccgctccacccccctgcatcactccttcctggccacagccggattccagcccaaactctgggtttggatgagtggcactggccttgttccatttgtctgtccccagccggccacgcccagccttgccctggcccggcctagctctgcgtgcccaaagaccacccctgttctgaacaccagtgctcagtaggcgtgggggcagctaggaaggctgggctcagtgcttccccacccccaccttgggggcctggccaccgtggctgatctgctcctgtccgtcccctacagtgtggctggctacccaaaaccacag

SEQ ID NO: 10619 - DNA, 1216 bp, Homo sapiens
gcggggcggagggcgcccgagggcgagcgggcaggcgggcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccgggtaagcgcggcggggccgggggcgggaccgcacagccaggccgccgccgggcgggcgccggggcctggcaagagcgctgtgcggggccggagggctgggcggggcggggggctgcggcctccaggctgggcccccgcctcggccactgcggagctgcgcccttggcgggagggccggcctggggtgcccatgctccctggaggccgtggactagcgaggaaggacgttcccggcgccgcctcccgctcctcggtctgagggaggcgggcagctggctgctcctccacctccatctctgtatccgacggaagcgccagcctggggtggcaggagggccgtggcggaggccgtcagggcttgggaggtgggggcgagtgtggttttatgtcatctcagtgccacccccgcgtcttgcacctgctgctcgcgtggtcggtacgcctgccggggtggtggagggcaaggagcagagggccgggcagatgcgccagtggggcctgaataccgtctcctcaggagcagatgagcggtggctactcccaggactccctgcctcgggttcctaaggctagcgctccttgccgggcctggcgttcagggccagtctagacccgggtgtcttctcgggaggcatccccaggcctgctggtggtgactgggaacagctcggctggaccctgctgttcctgttcaccggtaaggcctgcttgggaaagtgagcttggcatcaagctatcctgggtgcgggcccctccctgtcccctagcccagtctggccagaaatgggtgggaggccgtgccgagattccccgtatcctgctggcttcctggcctgtctcctggctgtatttacatggtggttcccttccttttcctaacagagttaggactgggctggagtgaaaccccccaggcctgctgaggaagtcaggggtaatgatccaagaggctgctc

SEQ ID NO: 10620 - DNA, 1132 bp, Homo sapiens
tagacatgtagtactatagtaccgtaatattcatctctcctcattttagttgcctttcagattctaaatgtttgggatcattcctatcatcttagtctcttcaggatctttagtattttcctggttctgaggaggcttgagacagggttatggatttccttgttctgtgtctttatccctactgatagttcctctttctcattttgcaaactacccagagctccaaggacagcctgaagatctcagtgcctcaggctctgaggtactctgctcacaggccccagacagatgctgttgggtaaactcaaagcttcctatgagaagcttctgagatgtagcaggtcacagaagtgttcacctgtttcatctgaggatttcagttctgaagtgatctaggcatgtttggtaaaaatgtttttgtgagagttctttttttaagaaagcattatgcaaaaagtcacttttaagggcatttaaaaatttttaagtaaagccattctttggcttttttggactatttgtggatactttgtttacattttgaatattaaaatgtgcatcatcttgtcggccatgcagtcctgcaggcatcagtgccctggctgtcctgtgagtcctcatgcagagcagggccatcatggtcagcccttgtgagtaagtgggtatacgctgaagctgacttccgtctgtgtcctgccctcccatccagcactctctatggaaatagttgtcatttcctcagtgatggtgtgtcttatagtgatggttgtaatggtgaatggctagtgtcattttgtttaattttgttttgctttttgatggtggataagatgaaattttagctgtttcagcatcaatccaacttaaaagcatcttggactttgttttcccttccaaactaaaagatcaaggcatgtattagacacaagcatatttgctgcctcaactcctctgacacccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagc

SEQ ID NO: 10621 - DNA, 1771 bp, Homo sapiens
aaggcccagctctgaacctcaccatgtgacctgggcacatcacctagttactcaagacccggttttctaatttttctaaaaatagagccatgcctgtcctatctgcttcacagaattgctaataagatttagattaaatgaaattacagatgggaaagctgaaaaatatgtatgaatattagttttgtaaaaggtttatcctacaaaaagggtttctgctctttgtcccttgccctctggactcataagtcttctgttcttttctccaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaataagctgatttatgtgatctgtctgagaagtgtttgtttatctacaaaagaaagcagccaggtggctcatgttcttgaaagtgaaaaaacaggaaaagggcttccctcttcagcttctctgcaagatgtgtactctttcccagaccgccgattctcaccggcatctgcaaagggcttccaagcgcctgtttaagaaggactgttcccctaccgcataaatgttctacccagatccagggtccctacaagggtggggagtgaggctctgttgggcccagccttagaataggtcagtaagttatcttactgagattgggccaccctttcaagaacaagggtaaaatagaaaacattttcacaaaaaaaactgaatttgccccaacagaagggaagtgatcagtatggaagggttgaaatgtatcaaggaatgtagaataaagaacatgattgttatgttggtcagctacacaaaaagcaactgtagaagagtcttaacagggttggaaaaaaggtaaaacgaaaatccatgaaggtag

SEQ ID NO: 10622 - DNA, 1504 bp, Homo sapiens
gatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatt

SEQ ID NO: 10623 - DNA, 1634 bp, Homo sapiens
tgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtg

SEQ ID NO: 10624 - DNA, 1253 bp, Homo sapiens
atggagatcactgtaaaactgtctttttcttttaaattacaagtacactggggttaactgtattgctggaaaaacatcaagaatgacagtcttatatttaaggcaccagtcattgtttccattttttttttaattcttcccttggattaatattttctactgaaaagaaatgaaatctcagttccactatgataaaagaaacgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgc

SEQ ID NO: 10625 - DNA, 1154 bp, Homo sapiens
tgggaaatacagaacacatggttcaataaagaaaagaagggagcccaggcgcagtgtctcacgcctatagtcctagcactttgagaggctgagacgagaagattgcttgagctcaggagttaaagatctgagatatggtgaagcccagtctctacaaaaaatacaaaaaattagccggacatggtggtgtgcacctgaaatcccagctacttgtggggtggaaggaagaggatggcttgaacccggggtgtggaggctgcaataagccgagatcacgccactgcactacagcctgggtgacaaagtgagaccctttctcaaaaaaaaaagaagggagataatgatgtgatggcatattttctatggccttcccaagaataccccatattcagcatgtgggcctgtctgcttggtccaaaatggctccgttcaaaatttttaagcagtgatgctgagagaagtcattttctgttttttacctaacataaagcttttctccctaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatggtatgctgctaaccttttctctcctgaagcctaactatatattagaatacctgtattctgtgctaagggcagcacactgacaaccagctattctaagcatagatcctgaattgataagaacaacatgcaccatgtcttttactcagattacctcatgtgatttttgttttcatcagttcttcagagtccaaaaaaaatgctggacaagatttttagcctcattgaaaaccaaagattgaaaatattatgtagggcactgatattcctttttattcttttttttatatttgaatgttatttagttagtttttttgagacaaggtctcactctgtcgcccaggctggtgtgtggtggtgcaatcatgcagcctgacctctagatccttctgcctcagtctcccaagtagctgggaccacctgcatgcaca

SEQ ID NO: 10626 - DNA, 1858 bp, Homo sapiens
aggagcttttagaggagtttggccctggcagaacccctgggtgctgtctgtaccccttgcggtgtgggggctaagcagcttctctttccctccaccgtgctctatgctgatcctttttctcgtgagaaaacgctggcctgttattattagctaaggtcacacccgctgggcagctcctgggatttttggattcctccccactccagagggaaggctatttctagtggcttcttttctttgagtcctcccttctgtctgcctctctcctgttcctcctctttaccagtagggcttcctcaatgctgacagccctgtgaaaaaaggggagacatgccgagctccggcaggaaactgctggcccaggacctggcttctggggcacaaaggagaatttctgtgtttggaaaagtacagactgagcaggtgacccccgcacagccccttgggggaaacacttgtgccctttgagtctgactgatataaacacagactctcttgactgtcccataaaggccaaagccagagaacctcagaaagggacttgcaaattgtgagtgaggcatatcagctggtgctttcttttctctgtgggctgccatttatgaatctcttggtttctctctgtctctgtccctccacttttctctcctttgctggtgtgtgcattccctctgacgccctggctctcactctttcattctgttttttattctggctccctctgtctttgtgtttttttttttaattttctttttttgaggtggggtcttgcactgtcacccaggctggagtgcagtggtgcgatctcagctcactgcaacctcttcttcctgggctcaggcaatcctctcacctcagcctcccaagtagctgggactacaggctcgtgacaccacatctagctaatttgttttgtatttttggtagagacagagtttcaccatgttgctcaggctggtctcgaactcctgagctcaagtgatccacctgcctcggcctcccaaagtgctgggattacaggcatgagccactgtgcccggccatggctccctctgtctttgtacgcctgtccctttgctgtccctctcctccacaggacagcattggcatggccacctccctcagccctcttcatttcccttgcagctgcatcaacagagagtggccgcagcagcaggtgacccattaactgaggaactggctgccactgaacacctggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatctatcccctcctcccccatacacacctaggcttgaaatgccctacaggcccagaactttctcacatctgaaatggaggcattgcaatgaaaaggcacccacagcatcatgcaagtggcatcttgtaaaaaaaaaaaaaaagtttaatctgaatctaaccatgaggaaataatcagacaaatccacattaggggcattctgctaaacatctgacccagactcttcaaaaatgaagagtgaaagataaagtagtcaatggccgggcgcagtgagattgcgccattgcattccagcctgggtgacagagcgagactccgtatcagaaagaaaaagaggaactgaatgaaatctcagatggctgaaatgttagagaaacagagcaccaagtcccctgctctgtgactcgttgttcctttcctctgtcttcaagcaccacgcagaaatacactggatgttc

SEQ ID NO: 10627 - DNA, 1178 bp, Homo sapiens
ttatcgcgagagaggagagaaacagttaacccagggccattcacaccatgcacatatgattgttttggaatgtctggttagctttctagttgatacggccttcactatgtaaaggtcagtctttttatttctcagatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggtgagatcaaatgaaagtttcatatagaaatacaaaacctagagaactggcatgtaagagaagcaaaaattacttcagcaaggccatgttagtaaatttgcatctgtttgtccacattaggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggtaagtgattagagtaagcggggaagaaaagtgcctggcacatagcaaatccttcagaatatatttgttcaataaatgtttgttgaatgaattgataaaatttcagagccagaagaaagatgtttagttaggtgatttttcagctgtagggaagtggttggcaccactagacctgactagtgttctgtatcatttcatcctactaaaaaattccatttaaacgcattaaaaatcactgatctactctggtgtcttcatatatttgataaggtaattaggttaaacctaattttagttagttgttgcaatgctggaattggaatccacgatttgtgcctgtttactacctccagtttgctattcttttccccataatgtctcatacagttttttaaaaatttaagcactatatttgcatttgatattatgatattgtttattttaaaaactgaaagcgtcatatggctatgtctctctcttaatttaatgaaaaattttcctaaaatcacatcattcttaatacatgcta

SEQ ID NO: 10628 - DNA, 1132 bp, Homo sapiens
ttaccagttcctttctccattttacttcacctgatcaatatagattatcttatttatgtttgtgctctaacaccaagttgctaatttaagcctccagtaatgacatgaaatattaccaaaaagaaaataaattacttccattccatatcaagctatagtaaagattttctatgcatacttgtcatgtagagttatcccataagcggaatactcagtgccagttgaccatgttcagttaccagcactaatttgtagataaatgaagcaaggagcattaatacaatgtatctagaggtttgatttagggaacatgattatgtaatttttatatggtattcaaattttctaaattcaaaatgaaacatggaactttagaaattaaaaagtaatattttctgtctttacttgttcctttattctcttacagaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggtatagaagccaaaatgataagaaactaagttaaaatctttttttaaaaatatgttaatactatatagaagaaatattggtttattgtgctattttgtacttaatgcttaaataaaaacacttgcatggactgtgttattggtaacaggtcacttaatgacatcataataaacattatttaaacagttctaaaaacatttatgtacaatatgtattcagagtatccccttttttaggcatgcatgagagatattccaacgtgcaagtggctggaccagtggacagaactagctcaaaggtatgtcctaaattaaatataagttgtaaaaatatgcatattgttgaaaatacagctattactgtatgatcaatgttataatttattatttagtatatataaacacaaaggtttttataagttctgtggatcttttaattgcagatttgcattccaatataatccatccctgcaaccaagagctcttgttgt

SEQ ID NO: 10629 - DNA, 2698 bp, Homo sapiens
gaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagc

SEQ ID NO: 10630 - DNA, 1170 bp, Homo sapiens
gtgcctgtgccaggcattttgtcaggtccccctcccagttcagtacaaccttggggcgtttggttgggatctcaggagcgaggccagccgtgtacagagtcagcaggaactgcagctgtcctgcgggcagccctgtcctggacgtcccagggtctgcaggacacggggggcgcccagcctcggaggaatgggtgtgtttgctttctccagaggctggcacagtcgtttggagtccctgcaagccaggtgggcagcactgccttaggtcccctcccccaggaaggcctccttccttcctgttgccccagcctgccctctgtgtgtgggaattagtcccagaggacaagggcctcttgcagctccctccacagtgccttgagctgagttccccaccgcctgggctccatccctgccttccagtgctcagctggcctcctggagcctcgggcccccacctcagcccttcccaccctatgcccattagtcagaagcagagcagccgtcccaggctgaggctcaacccctcactgtcccgtgtgtctgcctgtctgcgcagggtgcgaggagctgctgaaggatgtgctgtcggtggagagcgcggggacgctgccgtgcgcgccagagatcccagactgcgtggagcaggtaaggcttggggggcctcaaggacctccatggctctgcctcctccttcttggtcttgcctttgctccattttcagtatctgggaggacccagaacctccctctgaggacccttcttgagcatcagagtcaagaaatagtttttggaacaggagccctgagtccccttgggaagccccagcagaatgtgtaacagctgggggtcctcacccagcaactttatttcccatctgtggcacggaggagagactgagttccagacagggaaagtggcaagtggaggggaggcaggactagaattgtttccttttcttctgcaccatcgctctctgagctgaacgcttcctgtttgtttgttttcaaacaacaacgaattctccaattctctgacactaactggtgtccagcaatcagttccacctgccactaactacccagcattagcacagactccatgagtcaaggtcaactccatgagactgccccacctcccacgccagctgcagttcttcctggataactgcaa

SEQ ID NO: 10631 - DNA, 2181 bp, Homo sapiens
gggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatctgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagg

SEQ ID NO: 10632 - DNA, 1513 bp, Homo sapiens
cgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctactcacacaccggacactccaggtgctagtccactggtgctggtgttcaggggagttggggggggggggcgcggggacagaagcgcgggttcttggttccaatgagggacttagcagaagcctccaggggccagcagggccaggtgaaactgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcacc

SEQ ID NO: 10633 - DNA, 1513 bp, Homo sapiens; identical to SEQ ID NO: 10632

SEQ ID NO: 10634 - DNA, 1900 bp, Homo sapiens
ctctagggtgacgctgctggctaggaagactgaggtctgctgcgccaaggggcctcaagttagaagggccatgccgttcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctcgcctgactgaaccatgagtttctgtggttgggggagggtgggcagaagaggcctggttccagggctcacagggacagatggtctcccttaaaaagagcaacccccctgccccccaccaagtttgtggttcccagggtggctggtgctgtcccccaggggcagggtggagtggggcggtgtcactcttcagtccctaggggagaagacgtggatcccagaagcctctttaatgccaccattccagccacagg

SEQ ID NO: 10635 - DNA, 1206 bp, Homo sapiens
ccccgaactccgaggatgggagctgagggctgggtctttgcgggcgagatgagggtgtcggatcaactggcctacaaagtcccagttctcggcccccgggaccagcgtcttctccccggtcctcgccccaggccggcttcctcccgggctggcgtgcgctccggccaggctgcctctcaggtccacgctggagaaggagtggtgaggtgcgctcgccccggctgcgtgcggtgattcgggaaatccccgcacttcgctggagaaatagcgacgctctcggaagtgtgagtcggtcactgcttggggtccgtaccctttgggcagacgtggaccgcgccccggcgacctgggttgagtggacagacgggacccggcttacccatgggccaagccctgccacttaccgaggcctgccctgctgtgctttccagggcggcaaccttgagcttgggggtggggagaacggggcctgacttctagaattgcccctggggaggtgggaagcggaggtttggcccggtggcgcaggaagcccctgttcctctcccaaacaccatttcattaaagatggatctttgtggatgtgttcccaatggccggtcttttgttccctgaccgatgcaacataatgtggacccactctagtcctcttcaagttttttgctggaattccttaaactctcctttaaagtctcttatctattcctctagtgcgtttgcttctactccccgaaaacaaaaacccaccaacccctgaaacctcgggtttgcctggtgttggaactttggttatttgtcctttgtttgtgttgtgtttttggctcttggccgtggaaaaacatctggggacatgcagtgaggtgacttgaactgtgtgaagaactggttgacaaaatagggaacgtctggtccctgtcttacttggctttggaaaacaggagaggtttttaggagctgggaggagggagggtgagagggaggaaccatcacggccaggttggcccaccccttgccaggtcgtgtaaaaacccattcaagaggcattttcccacaggctccctgcctctgcaggccacgtgtagagtagtcctttgcaggcgtcctgcccatactgttgtccctgttttgggggcatgtgggagccaacacaggggagtcaggtgtgtggtaggcagtcaggtgtgttttggggtcagggaggcaggt

SEQ ID NO: 10636 - DNA, 1197 bp, Homo sapiens
caggccacatggacgtctctgcacagagccagctcatccggccccaggcgtcaggtgcacgggtgtgcacagagccaggccccacccagttcaggacagccccagagcccactccttttgccttcaccttcctatcagatgctcctatttttttaaaaaaatttatttatttgtaaagatgagggtctcactatgtttcccagggtggtctcaaactcctggcctcgagcaatcttcccacttcggccttccaaagagctgggatgataggcatgagccactgtggctggcccagatgctcctttttctgatggtgcctgcaccagggatggttccctgtgtcccaggctcagagtttctgggttttccttgtcttggtaaccacgacagcatagtggctaccaacacagaccaacctgggttcgaatcccagttcgacttctgactaactttggcatctagtactggtaacatgacttcccttagctgctgtttccccattgtaaaatgaggataccatctacatctacaggattattgaatgagaaaatgtgcacagagtgttagcacccttcctggcacacccaggaccccaagaactgttttgggtgcttattgtgatgtggtggacctgggtttcagttctgatgctgtcacctctgagttgtgtcatttagcctgtctgggcctcagtttcccatttgcaaaatggtagtaaggatttttacttcatttggctcattgatctaaaatatgtaaagggtacagagttgctcaataaatattagtgaatgttattattatatgagatgcaaggacttacttttttttctcaaaggatatagacaggggacatagagaagactcatttcctgtggaacagtccagacttcacatattcaagtttttataaacattattcttttaaaaaagaatacatgataaacattttggagaagagaaaaggagggggaaaaactcactcacgatcccaccacctgaatgtaagcactgtgagcaagcatgctgctgcacttccttccagggtttccacatgcattttattaagtggtcgtaattacaggatatacgcagttttgtattctttttcttctacttagcggcatatcataaatgttaccccatgtggctacatgttattggcaattgtgattttttttatggctgcataccatc

SEQ ID NO: 10637 - DNA, 1192 bp, Homo sapiens
ggaaaaaaaacaaaaaacaaaaaaacaaaactgatgaggcacagtggctcacgcctgtaatcccagcactttggaaggccaaggtagaaggattgcttgagcccaggagttcaagactagcctgggcaatatagtgaaaccctgtttctacaaaaaataaaaaaattagcctaatatggtggtgtgcctgtgttcccagctgccctggaggctgaggcaggagggtcacttgaactcaggaggttgagactgtagtaagccatgttcccgctactacactctagccggggcaacacagtgagaccctgtctcaaaaaagaaaaaaacacacaaaaacaaaccaaaacctgccactatactttaaagaagctaagagaggtattgttaaacaaagcgtcctagggaagtaacaatgagaagttaagtttcttagaaatcttgagttgaattgatatttaataaggttacctaataacactctgtcagttatctaattgtatgttttttttttaaaagatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatccc

SEQ ID NO: 10638 - DNA, 1151 bp, Homo sapiens
ttgctctgagtgacttggtcagaaggctggctgtgttctggagtgccattcctgctgggcaatgagaattctgtcacaatgaggactgtttgggaatgaatccctattttacatgttgattatcttaggaggaacctgcctttttaactagttttcagagcataggactaaactgtcattttatagcataaaaaaattgatacataatattttacatatttatagggtacatgcgatgttttgttatatgctgttctctaactaacattttttaaactgggagtaggtttgtctgccattgtggatttcctgggcagagtggagtgaaggtgccaaaagccaagaagacactgaggcagtctttaaggtataggctccgtgttccaagtcttgtggtgtggggaatggcagaaggttccctggttggtcagctctagtgttgcaggtgcgcctaaagcactatggagtggcctcaggtggttctgggaaaatctgttttggtatctataagttttctcacatagcttctttcttttttcttttaaattgtagaaagctctcttagctgtcataggtgccgactcagtaaccctgaagaataagtacctggattgggcttatcgaagtggtggctacaaaaaggccagagctgtgtttaaaaggtactcacagacgttcatagttgttactagtccctctaccccatgctcagccgctcatacccagattatttgaatcacagatagcatctgagggagtaatctgatacactttttctttttttttaagatggagtcttgctctgttgcccaggctggagtgcagtggcacaatctctgctcactgcaatctccgcctcctgcgttcaagtgattctcctgcctcggcttcccgagtagctaggattacaggcacctgccaccacgcctggctaatttttaaattttagattttaaagacaaggtttcaccatgttggccaggctggtctcaaactcctaacctcaggtgatctgcccacctcagcctcccaaagtgcagggattacaggcatgaggcaccacacctgacccaatacactgtttcattttcctttttttttgttttttttttgtttttttgagacagtgattctcccgccttagcctcctg

SEQ ID NO: 10639 - DNA, 1208 bp, Homo sapiens
tttgagatggagtttcactcttattgcccaggctggagtgcagtggtgcgatctcggctcactgcaacctccgcttcctgggttcaagcagttatctgcctcagcctcctgagtagctgggattacaggtgcccacaaccacgccaggctaatttttgtagagacagcgtttcaccatcttgaccaggctggtcttgaactcctgacctggtgatccacccgcctcggcctcccaaagtgctggaattacaggcatgagccaccacgcccggccaacatcagttttttaaaaaaattaaaagaattccagaaacgttcattagatagatatttctgaacaggagtagcattgggagtagcattactccactaagactgtagtcctggccaaactgaacttacttttcccctcctctttctctcttgtcgttttctttcttttttttttctactgggtttgtagatcagagattgtcagagacatagtgtgtatcaggacttcagcaagagatttgcctcttggtgagcaagatagaggagagtgaatgtgatgagtgtagagaattgaaaagttactgcttgtttatctattgtctgtccacttggaaagaggtgtactgcaagattttttcatcttgtaaatgcatggaaggtttgaataaagaaaaattatgtcagaccaattttccagtgggggagaatagctaatatgttggatgacggaatcaggattcagaaagaaccaataacaagatcacatgtttataagactagaagttttggttgggcatggtggctcatgctgtaataccagcactttgggaggctgaggcaggcagatcacctgtggtcaggagttcgagaccagcctggccaacatggtgaaacccccatctctactaaaaatacaaaaattagccgggtgtggtgttgggtgcctgtaatcctagctactcaggggctgaggcaggagaattgcttgaacccaggaggtggaggttgcagtgagccaagattgtgccattgcactcccagcctgggagacaagagcgaaactccatctcaaaaaaaaaaaaaaaaaaaaagactagaagttttgagcttagatttaaaaagacaaaagacagccgaacaaacaatatatgaaccttggctaagctattgtttttggaagaggtcctatgagtagattgctcactcaaaatgag

SEQ ID NO: 10640 - DNA, 1151 bp, Homo sapiens
ccgcgaccggctttcaaaaatgtttaattgtacaatatcctcctcctttgcttttttttttgttgttgttcttggtgttgggaagtcaggacgtgggatgggagacaatattctgaagaaaatgcatctcgtgtccctttcaggcttgagcagcccacctctctacacctggaggcgcttttcctgatggctgtccaagtctagcggcgcgcgcacttaacccctccctcccgtctagccccgcccctcaactcctgtccgctagagtcgtcctgcccaagaccagggcgggttctcgctgcaatcccacaatcggccacagggaggggacggtggctgtagaagccgaagggccttcccctaagtaggaggtggcggaagcggaaaaggcgggacctagggagcacgttacgtccggacgcgtcggtggtagggctgggtctccgaacctgaaaccgggagcttcctgctcgtgttcgctgttgagaagctacccgcggggttgtagacctcggacctcatggcagagataattcaggaacgcatagaagatcggctcccggaattggaacagctggagcgcattggactgttcagtcatgcggagattaagtgagagagggttggggagagggaagagctgaggcggcctgaggggaggttgggagtgtgtggcaggggctagatgtggggacgctcgacctgtgtttacttttcctaacgtggtggaagcccatttctcgttttcggtgatgtccagaattaatttttcattcgttgcaaggtaatccgtccgtctacttacccatcagacgttttgacagcccttcatggagccgggtcttagggctgtaaaggtgataaacccaggattcctgctcattaggagctaattgggcagagtgtggtgggggagacagacaaattaaatattttgataacagtgtactgtaagttgattgtagtaccttgtactgctgtagggatgggaacagagtgctgtgagagcccagggggagtggataaattcctaactagacttgaaggtggggaccattgaaatcagtttcatatgctactccagagcctaactacagcgcctggcacatggtagacattcagtagcgtgttaaaattatgtttaatagttt

SEQ ID NO: 10641 - DNA, 1143 bp, Homo sapiens
ggcagttactcggcctcctcctcctcctccgcggcggcagcggcgggggctgcggtgttaccggtgaagaagccgaaaatggagcacgtccaggctgaccacgagcttttcctccaggcctttgagagtgagtgtgtgcgaggctttgagggcaggaagacccactctgccaacaccggggatgggacactctgctgggcccccttcctcctcgggagtccacttgtgtggtagtggagggaggaattgaggggatgtccccctttcggagattacgtctccaggggatccggagtccagggccttgggagagctggaaaagagggtccgggcgggttcttgactcccccaagattgacgcaagaggctcgggactggggccccacgttcagagcaggcggcttttagatgaggaggtagcagttgaactgagccgcagtcacatcccgagactggttcttgttttctttcatgcctttcggactctagaaatacaggggtttcggttgtagcttttgaggggcaaaatgaagcctgtgaagggatgagtgcagtggaaccgaagaaagtgtccttagtctgaaatgccttcgcgctaacttggtgctgcaggttcctatggcacctttggatgcttaaaacccttcaaatctatccacccattttgtggatatgtaaactgagccagagagtggtcaagcatcttctctggagacgaccccggaattctgctttttctacctggcttacagaacattttcttgcgtcaatttctgtttctaagttctgtctggaaggtgaaactgacttatttggaaaggagagcaaggtgtctggaaacaaacaatagaatttattaaaaacatcgtgactatgaataatcctgattgttctttaaggaatgttatatcctgattggttcccttttttgcttttgtgtgttataatttgggtgatctttaatagctaaataatcttacagaaacttgaataaacttggctctaccgcccagtgtccttatttacagtttcactgtggcatatgttaagggcatggtatcagctgtgcttagaaagacgtattacgttgtttaatacccttccttcattctctctcattagtgcttcatgaaattctaattg

SEQ ID NO: 10642 - DNA, 2715 bp, Homo sapiens
cttattataatggttatcactgttgcatttgacaaaaatgctttgtattgctattcatattctgtttttattaaataggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctgttttggggtttttttgttattatgcattgttaacatgtacattaaaattttgatttagatagcatagtaagatttcagcctcaaatgagtcagagctaataagaaattaggaaaatcttaatgtgaaatcctgctttcagcagttacaactaatatgtcatttatggtattacataaatatttaaaaatttatagttcagagtaatgaaggagagagattcatttttcacagcatacctttttatacta

SEQ ID NO: 10643 - DNA, 1344 bp, Homo sapiens
ggtagggaaattggttggatctcaaggatacagaggtccacctgatggaaggagatatctggaacaaaaaaaaagtatcttaaaattcttcctactcataaacagcctttaaatagtcattatttttagggaattttgtctatgagtcaaatttaccagtatagaatgttccctggagaatatattatagaggcacagtgaagttaatgagattgaaaaccagaattttccatgacaaaaataagctcaaagatctgtagaacactactctcatataactttgtgcatgtcagtatattccttgagatgcaatgttggccatttcctctagtgctctctcttgctgagctgggtgtatatgtgaaacaattctgaaatcagctctgtttcattgagatacttgtgaattttgttttgttttgagctttacaatgcaaagctagcatccgtatgttcatgaatctggttcttgccattatgttacatgcttttctcctatgtgactctgtacactttatttactaatttactttatttcaggttttctctttttacacacactttttatccagagagggagacacgaaactacttggactgtgcttcgacgatttggttatgatgatgacctggatttgacacctgaatatttgttccccctgtatgtacctttgttttttttgttgttgttgttgtttaattttttattgagacaggatctcactatgtttcccaggctggtcttgaactcctgagtcaagtgatcctcccaccttggcctcccaaattgctgtgattaaaggcattgagccatgcccagtcacctttggttttgtaatgattttacttgttaaatatttttaaggttgatttagcacacatggggaggtgggcttcaagctaattgggaatattttagaattatagcagagctttatagcaggatttctcaacctcagcactattggcattttggaccagaaaattttttgttgtggatgtcctgtgcagtataggatctttaccacatccgtagatgtcagtgacacttccagttgtgacaaccaaaactgttgagaaattgccgaatgtaccctctgaagtgaaattatccccagttgagaaccactgattccctcatggctcaaacttttcctcttcttgtcgagactacaagtatctttttttgttcattttactgaggaaggaaaaataagatgctagacaacaaacttgttttgggagtcaagagatctcagaaatatgttgattcacatttttcttacattgttcttctccctcagttttatagcctgttcttagcttaagttgaagtaggtattt

SEQ ID NO: 10644 - DNA, 1640 bp, Homo sapiens
aacttctttatttcctgtgtgaaaaaaagtttacaaatttagatgtctactcccacaaagtagctaattgtctttattagtatctacattgtgtcattttcttaaagtaatgattaagtaattatatatatggctatattgatcaatgtttttgataagcattactgtatgcagttagcttgacaagtgtgctaatacttccctaaaagtagactgctaaataactggtatagggttttcatactaatcatgttttaaataataattatattttctgactgcaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtgatcttgagttcttttgtcatctaaagtaaatatttctgtacagatgtgagtgaagtcctctggtttctatctctcatattgaaaattattctgtataaaaggaatactcagccgggagtggtggctcaatcgtgtaatcccagcactttgggaggccgaggtgggtggatcacctgaggtcaggagtttgagaccagcctgaccaacatggtgaaaccctgtctctactaaataaaaaaaattag

SEQ ID NO: 10645 - DNA, 1596 bp, Homo sapiens
taatcttcctcggccaggacaggcccccatcggtaatccaccagttggaccaattggaggtatgatgccaccacagccaggcatcccacagcaacaaggaatgagacccccaatgccacctcatggtattcctctttttatgtttttcatatttagtggattttctaagttcacgcataaaatattaaatttatctgcagcatacgttgcacttaaaagtacaatgcgttaacaatctatttttttgtgtttgaaattcttgattttaggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagttttgatatatcattggattctgtctttgagttgtaggttatttcttagctgcatgttttaaactgaatttgcatagagttgtatgttaatgtttcagttaagagaaaaacttaagatacatgagtcattacataatgggtatgaaatctttataatcacccttccaccctctatggtgtcagtacacatcacgtgtcatagatacttaaaatgtaaatgttaacacttttccttcctgctgagatgtttagagcctagtgccagacccattcatttccttttgattatttttgagactcagtactgcatggacctcagaagcttttcaggtgcaaacttctagaagcttaggtgcatgcagtaatagcttcttgtgctgttaatgggttattatatattattctaagtgtaatgctgagaatctaaatgtgtctctgttgggatggttaacagatgaattggcaatttttatta

SEQ ID NO: 10646 - DNA, 1141 bp, Homo sapiens
ctgtgattaaatttagaataattaagtaaggggtgctctcccaaattctcaggaatttcatgtatacggttattgacaaactgcaatagggttagtagacctgtttcagaaattatgtgaagctttatttgcattttatgcaaagaaggttgatactttgtagcaaggttttttgctctctgtataggtctgatgggcaaaaatggaacttttaaatatgggatagaattctaattaaaaattaattgaaagtgttaggcattggcagataaaacttaagctcatgagttcctgagtttgtagctataggctcagaggtggtgtacccatttaatatatttgaagtgtaatttttgcatgcatccaaacgtaattaagcttctagaaaataccttttttctaaatgcttctggggtccatagtgtggttgaattatgagtggagcaaattatattcatataattaactctgactcaaccttccttaagtagtagatgaagttgagtcaaagtggatgccaactgccctcacagaagacaacttttgggacttgataattcaggcaggcattgtgattgtcataattaaggaagctgtaaggttagtagggctggcaactttggctctaccttacatccaccccttttagaaaaacaagaaaacattttgtctggcactagtttctgttgtataagttttcatactgtttaacaagaccacagcaggtaaggattaatttttgagtggctgctggaattacttgatttgaatacttagtattttagtagtgtctcacacatttgccattaggtatgaataaaatattcctactgtactcctattccactaagttacattttgaacttagactcaccttaattaaacttaattaattggggagggggattccccaacaaaaagaagtacgggctcagagtggaattgtagtggacaatagttaaaaacaaagctgctccttttgcttgcttgatcattgggatttttaaaaaaaaaaattttaatgcatgtcttttaaattaattgggaactgtttttctaaaattaaaattttcttcttcctatagccctgccataggacaggctgaggctgagtctcagtgttgccctgttcagtctgagg

SEQ ID NO: 10647 - DNA, 1212 bp, Homo sapiens
tttatgtatatggtgtaagtctgtttgaatttgatattctagtttgagatgggggagtcagggaagaaggtatatttggagaacattggtatatctagaactctttacttccttcatcaacctagtgccccagtgtttcttatatagccttgtgattgctagacaagaagagagcgagattgtgtctttctgaactggataactagatttagcattttataggtagagattcccactgtatttaaatcttaggagtaagctcataggactgttggctctaatattgtccttaggaagcagaaaacttcaaagaggtgtgtttttctcttggaagatagcacattagtggaaaatttaattattgcatggggtctagaggtaaccttttttgagttcaggaatttttttttttttttaatcctgagtgttatgagggtgggagagtgagctattattaggtattaagctgatggctataaaggagaatgtcttttcctttttcaggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtaacagacgtagctattcctgggatgtgttttcttaaagctcatcttattttataggtggaaggaatgggggttggggctggagaataaaattggctgatttggctctagcttcttcagagaaccagttagaaagctacctttctaactagctgctcccctcctgttaactgcctaaaatgtattaagaacatacctatctgtggttgaccaggcaatctgacttttagaaccaaacttagaaaggtcgcacgtagaagactcccttagctcttagccacttactcagaatagtagcattttcctttgggattggcctaccccaagtctgttgactcttggagatctttgtaaagttggttgacttttccaaagggcctcaaatcagggctgaggaatgataacccaatttcagctgagtgtggtatgtagttttccgatggagtgcgtgaatgtgaggctgggaagccatggattggcaggtggaatactttcttttgtattcagcagttt

SEQ ID NO: 10648 - DNA, 2565 bp, Homo sapiens
cgtggaaaggaaattatcacagatgattcttgacaagaaatttcatggtaagtaacagtcacacaggcaagggggctggtggtggtgatgagatggttgaagaagtttattttcaaagaagatgttctatttgtttcccccgatggttcaccctggggtcctggcccctcttccctgtgatgagaatgtgtaataagcatgtgtacatggaatagggagatgaattctatttcccttcttttctggacacagtgagtcaactagggagtgggctgcttcacaaacacttttgtgtctaacctcatcttttacctgggttgcccttgtgtttcttgcagggattttggaccagggggagggtgtcctgattattttcgatgaacccccagtagataaaacttacgaagctgctctggaaacaattcagaacatgagcaaagtagtggattccctctacaacaaagccaagaaactgacataggtgagtgctggcttcaggaccccagggctgggcagctctgtcttctgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataatttttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagctta

SEQ ID NO: 10649 - DNA, 1205 bp, Homo sapiens
ctaagttgatctaaattaacttttaaaaatatatggttcagtttctatcgttgctttctgtgtgcctccccgtgaattccctttcccctcttaatttacaaaggtaatcctctctgggttttggctgtcagccgagctcattagaagggtgtataaaaaaggagttaatatgttgtaatgaagactgaggggttaccttgggtatatcagtcgtagggcaagagttttaagatgtctgttttttatcttctctgctgagaggtattttttattgctttgctgtgtttggctggaaaggcaagtaggccaaactgagttctaagtaggtaaggtgctactctaaaacatattactgcccttggtatttgaattgtttgtgtggttgaacaaaccaaacatgatgagtgcatttttccacacagtgtgcaatttatgactgcttgttgacttgtggtaggcagctgctattggcagaatctgttactgtttgcatctccacctctcaggttcctattttatctgaaactcttactgaaaagaaacctcttcttcaacttcttgatttaccctaggctggggttcccaaatccagctttgtgtcatgatcacccagcttttaaaatacgcagattccccggactctgtcttctggagatggtgatttattaagcctccttagtgcccaggtgagtctcatatgcagccaggctcggagccactgtcctaggctaacgtttttcactccacagttgtgttctattaaaactaaatggactatcactgtaatgtgagctgactgacatattaacaaatgtattacaacttatccaaatagtcagtgttcttagttctgttttggttattaaatcaatttaatcgttgataatcacactttattctttatccttacaacaagttttccattttttcacccgatggttatggttatccagttttagctacaatgtatgtatttttctgtcctcagattatccataaaaactgtataatcccaccctccttgttaataccttgatttatttcctttacagtcttttctagacatataaaaaatgtacatattcaaaactttggcatcttcctgcttatacaacatatagttttgtaaactgttttctcacatagcatggtatcttaaatgcttttccatgccattaaggtgcctttgaaagtatggtggcagc

SEQ ID NO: 10650 - DNA, 1181 bp, Homo sapiens
ctactcctcactttggttttcagttacatttttttttttgagttggataaaccagccctgggccttaccaatttgtaatcaataaggaatgtttaagtgagggtgtgtctgtcctatgtttcagtgggcagcggttggggaatatgctcatctgattgactatatctgaactgtttcacaaagcgctctttggggagatgttaataggtgtgctgcagaaaatggcttccacagtcttaaataagcttgtgagagacagcctgttatattctccttggagctttaccaggtacatctcagaaggctctgaggcaggcttcagttaaccatgtttaacccagccatctccaaatttatttgagcatggagccaactttaaattgcatacctaccaacatcctagggaagggtgtgcagtttggggaatactagtcaaaaagtctatctatttgggcttttgtgcaaagtccctcatttcctaggaaacctgaccctattttctttttttccctaggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgta

SEQ ID NO: 10651 - DNA, 1210 bp, Homo sapiens
attcctaattccagaaacaaaacctaaccactaatatactggtttaatttctttcaggcttttttctctgtctaggcttaatgttttagattttttaaatatcaattttagattattctctgtgtatcattttgcaagccacttttttcctttataacattaacattttcatggtattacatacccataattcaatgactacataaaactccattgtgtggatgtttcataaattacaactcattcttctgtcagatatttaaattgtttctactacttctttatcctggatagtgctaggatacataatttcaagactctttaggatagattcccaaaagcataattactgaacaggaacatttttaaggcatttgataggtgccatctgttttccaatcagttgcccaaatgtaccctctccccagaatcgtatgagaatccccattttacaatacttttccccacatgcaatcattcttttaaagtatctattctattttgactggtgagagatcatttcacactgttttgcttttcattttggatgaagagtgtgagaccaagcatcttccatatgtttacttcttggtgtatttcctcatttgtgaattgtgacagggcttcgtcttcatgtatagggaagcctcttagtagagaaagtgagcatgagccagatgcaagaattcaacccttgcctccttttgccagctgtgtgactctgggtgtatgtctgtagctcctgagcttctgttctctggtctgtgcaattagaatcctaatcctttcctggcaagtctgttgggaggattaagaaggtggctactttcacccacctagcacagcagctggcatgcagcagacatgcaattttagtttccttcttcttgagctctgtggtttctgtcattccctccaggtgaccccttaggtccctgtgactctgggatcaacagcatcggcatcacctgggaacttataaaggcagagtttcaggccaccccagacctatcacatcagaatctgcatttcaacaagatctccaagtagctcatatgtacagtaaagtttgaggcactctgatttaggctttgagattgaagatgatggtatgcttcccagacacaataaccagcaccaattgaaggataaagggatagatttaggagcctggtgccagggagctctaatataccacctcatccacaca

SEQ ID NO: 10652 - DNA, 1496 bp, Homo sapiens
caacattatgtaaagcacttagcccagagcctagcacatagttatctagagttgggaacgtcactcctggtgtgcatgtccagaccctacccgggagaagggcctaacctatgactttagaaccctcagttgcaggtgtgcatgttccagccaacactccactctgagtgcaggctcatcaggacaccatatggttgtaaactggctgccatgtcccaatccttccagctcttgagggtcagttctcaccttatgaacaaattaacaggctctggacctataagatcaaggaccactgcgccccctggccaccccaccgcccccccccaactttgatctgattgactttggcttccacctactgtttaaaatgtgtatgttgggggagtagggacagcacgggggaggggtttactttcctgactctagcccaggacatttggtgtttttgaataggcaccattcagccttgcttcagtattaggaataagatactttttattccatcctctatggagacaaaaagctgctcctcctttgagtactgacctacatagatttccatttctctcttcagcctcaggccaaacaaacaaccggacagggcagcagaacaaggctgtctcctcaggatcctgccaaaggcactgtcctctccaacctggacccagccccacttgcccttattggttgcttacacccagagtgcacactcacaggaaagggcctctgctggctgcaggtgatcatcttgtcccttctctgccttagtgtgtgttattgccatttcaatgtcagtggttttttatgtattttcttccagtctttgctgctgagatctgactgtatatactattttgtatcctttcatgtatttctttcatgtatttcaatgcagccctcaacatcatcatcataaatctctccagcagaatgctggaggcctccctcttctgaacctctacatgctgctggctggcatcaagcagaggtcatcactgggtgctgaacaggtcagctccctagggcaatgtgagcaaagtgttgtggctcatcctcgatcctttatgcccttttggcaagattcctttctcttctcagtcacagcagatggacacataatcttgttctcccaggggctgcattctcagtagtcttttccctgctccttgggcgcctggtcagggaggtttgtacaagcctgcgcacacacagcagtctgtcacgaggctgggccaaccttttttttttttttaaacagactcttgctctgtcattcaggctggagtgcagtggtgcaatctcagctcactgcaacctctgcttcccgggttcacaagcaattctcatgcctcagcctcccaagtggctaagacttaacaaacaggcacacaccatcactcgcagctaagtttttgtatttttagtagagaccacgtttcgccatgttgtccagactggtctcaaactcctggcctcgagtcatccacgcacct

SEQ ID NO: 10653 - DNA, 1257 bp, Homo sapiens
acttgctagtaaaagagaatgtatgttagccaagagctcagagggccttctctgctgcttaactccaggtacttatttcaagcccagaccagctcctgtgctcccctttgttttcttggctgcaggccacagaaatctagctctcttttctatttgatgtttaggaactcactgtggagtagggcacggtctttacagctcctcttttttttttttttttttttcctgtgccggaatacaagcccaaaagcttttcctgtttttagggtagatcctaatggctgtgggatggtacgaactccctaaacctctgcctggcactagagtgaatcctgctgagctgtttctcattttgtatttaaaacagttaaatgacttcttcacctaaactcttaaatagggcagctaagatttgtacttaggaaaggaatagcatggaagattggagctcatgtagaatgtatctggaagcttaaattaatgaggtaattcttttgcagcttacataaactggactgtttacttttagccaccatgtatacctacagttgttggtgattgttttctgcaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtaataagcttctgcttttacaaagagagcagtatttaaaatgagtcccttgttaaagcgtgtttaatatgaaccttgtctttggaatactgggttatggggtagctatgggaaacatgactttgtgtgtctcacagattgtatatttcatatcctaggtgtttttgaggtgagaaccaagtactaaaatgcagggatcttaaagcaaatctttgtattgtacttatgctcatatttgcccatattgcccatgatgaaaactttcatcattttcttcaggaggtttggccgtaaatttatatatatttaagattattttcttcagatcaatatttgtggtattttctggtggtgtgggactagaaactgaatgaaaatgatctttattacctaattattatcatgcatttctctataggggaatttctagggcaagatta

SEQ ID NO: 10654 - DNA, 1099 bp, Homo sapiens
ctagcagttcttcatggcaacatgtgccctgatgcttaaaaaggataaaaataatctgccaagtggaactgataagaatagaggcgtatagaggaagtttatgcttttttttttttttttttttttttgcctgagtggagcgagaggagagcagagaggcacagattaggtattaatacagtctcagaagggtatatcagtatatgccttcaccttcctttcttctgtttctgtgtaccctaggcctgaaatcttgaagcaggaaatcaaagtcttctttgtgaagtacaatgatcccatctatgttaaactagagaagttggacatcatgattcgtttggcatctcaagccaacattgctcaggtcagactttatgcagactcaagttgatgatgatttagctcttaaggtctggcctttaaagaagctaggctgtgagattgctatttgagaatccttaatgattaaccacttcctgggtttaacaggttctggcagaactgaaagaatatgctacagaggtggatgttgactttgttcgaaaagctgtgcgggccattggacggtgtgccatcaaggtggaggcaagtgtctgatggtagttaggatcatgtattggggattctgagagttctcttcacttttttctttaaaataatttttaagtttatcaaaataataaagcacacagtttcaatgttaaagaatttttaatggaaagcagctgtctctggttcctcccttccctacctagactttcttctcagagggaatatttttaactctgattttgcttttagttattcttttgattaaaataggtcctccatatccatgagttccacatccgtggattcagctaactgcggatcaaaaatattcaggggaaaagaaaaaggatggttttgtctgtactgaacatgtacagacctttttttgtctatattccttaaaaatataacaattatttacatagtatttacattgcattaggtattataaataatctagagatggtttaaagtatacaagagaatgtgtataaatgcaaatactataccattttatgtaaggcacttaagcatccatggattttgg

SEQ ID NO: 10655 - DNA, 1271 bp, Homo sapiens
ttgtaaaaatggcagtgtggctcgcacctgtaatttcatcactttgggagaccaaggtgagaggatcacttgaggccacaagtttgagaccagccggtcaacatagcaagacccccatctctacaaaaaaatttttaaaatttagctgagtgtggtggcactaaattgtagtcctagctacttaggagactgaggagggaggatcgcttgagcccaggactttgaggttacagtgagctatgatcatgccaatgcactctagcctgggtgacaagagtgagaccctgtctccctgtctcaaaaaacaaaacaaaagaacatctgatgaatttttataaaggttttaaggtctaggtcttaaaaaataattgaagggaaatttaagtcattaaaatcttctgacttaaaacctattcattctcttgactaaaagcttttacagtttggtggtttggtttagggtcccttgtttgtggttttgcctttagccttcactgttaaattagttcttagttttgccctcaataaccatagttcattttttttcatcaggtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtaagttcttgtctcttgtctatcctagtagttttagatgtctttggggagatttcagagaaagcaaaggttataggcagtttcttctgtgtctgtatttacatatagtatgttcatttttctcccaacagggatgtctcttctcagttttactaattttttgtttttgttttcgagacagagtctcgctttgttgtccaggctggagtgcagtggcaggatcttggctcactgcaacctttgcctcctgggttcaagcgattctcctgcttcagcctcccaagtagctgggattataggtgtgcaccaccacacctggctaatttttatatttttagtggagacagggtttcaccatgttggccaggctggtcttgaactcctgaacttaggtgatccacccgcctcggcctcccagagtgctgggattacgggcatgagccactatgcctggccagttttactgattttttttttttttttttttttttttttgagacagtttcactcttgttgccaaggctggagtgtagtggcaggattgtggctcact

SEQ ID NO: 10656 - DNA, 1167 bp, Homo sapiens
ggtgtgaatgtccatctccctgaggagagcttcctactaggtatttatgcctaaatgggaaaggaaataagactttgctgaacccaggtggaaatggaactgctgtttaagttggatacttctccctctttctataaaaacaaactcctttcttagggtacccgtaggccttttgcacagaatcatggaagctaaaattggaaacaaatacaaaatcttggatcactgtgttcctgtatcctactgagtactctcttgataaagcttctaaagaatgtgtgttctcatcaatgacgaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaatctagtgaaaatctagtggtatgtagtgcagcagcaggagaaaaaaatgcagagaagtcatttctcttattcctctttccccattggtattacgtatggattctagaatgccactgctcagatgtggttttcatggattttagtgtacctttttagagttccaatttaggtttgtgtcactggggctcttcttgtcttgtcttaaccttacttgatgtcactcacattgaagttcaagaggggaaactcccggttaatgaag

SEQ ID NO: 10657 - DNA, 3707 bp, Homo sapiens
tcctcctgaagttgggactgagatatagccatcctcttgtcagactgagaaactgaggcaggcagctgaaaggaccatcaacaagttaagggctttggcccttcccttttcatttaataataatccctataactcttagaaaagcattagagcagctgttgctctgcagtcagtggctttgatgtttttagtatggattatttcctaatcttatagacccacatggaatggaggtagaagcacagcacaacttgatattgattaaattgaaatgctaaaacccacagcacttattaacataatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaagtttgtggtatgtatttttttccccagaactgacattctaggagaaaacacagcaggccagagagggacagaacattcataaccactctattaaaacttttctgactgccccagccctcccagggattcagccacatgaaattaagagtgacttgaggaagaatcatatacctcctgggggctccttttgaccaagacccaaagcaccactgcaactccaggcatctttgcaggcagggagtgctcagaggagtcaatctgtcttttcctggcagttcccctgctggggccccaggcaaatggtcccaggggcagtagccggagccacagggcctttttctgacttgtcagttggcatccagccagcagggcccagggcgagaggaatgcagcagagcttctcatcggtttattacccaggatgtctcaatcatctctcaacttacaaaagtctctcaaacccggcctcagggcc

SEQ ID NO: 10658 - DNA, 1176 bp, Homo sapiens
tattctctcccgttctaccatcaaaatcttaaccttgctttgtattcttctagtcttttttctttttctcatatttagaaaataaccgtttggaaaaaatacttactctagtttagtatttttcatgctgtgcctccagctttatgttatggtttaatagtatccctttggcttggggttgggaagatttagaaataagagtatattagatatgtaataagcttgaaaagacatcttgtggaaatagatccttgggaaaacacttagatggaaacaacatttagaactctgtgaaatggaatttactgaaaacttagaggtgctactgttttcctaagcactctacttgtgacagttaagtgtagattgagcccagggctcagcacattagagacttaaggaagaaatcatttcttcaatttttcctctgcagtggtggtgaccgcggtggcttcaaaaattttggtggtaagtgctgagtatcccaaaatgtttcagtggaaatgctatataaatctaaaagccaccaatatcccgcagatgtagtcaaaagtcctttcttactctgttgaggctggtgtgtgttgtgtgctttaaaaaaaattttatatatatatatatacacatatatatatcaaagtaaacattaaaaagccaaagttgatctcaaaacagtccaatgggttttctacacagtgaatttgcatgaaagagtctgtggtgaccaatgaatgacaccttcactggattttgacaatttgttcttataaaggtagctgacatggtgtttttaaattattagggttgtccaatcagcctttacaaccagagcttaacaaaagtgatactagcataatgctaaagtggcaggtgctgtctaggacaagttaaaggaaatgttgacattcatcttgatttcctaaactttaaataaaacataatttatatatttactttgtaaatctgtgatggttgactttcaaggattttggaagtattgacttttcatgccttggtttattactattttttttgttaatgattttaaataaattgccttaaatagctcttttttcttttcttttcccttaggtcacagggattatggacccagaacagatgctggtaaggtttatggtggtttgtcactttgccattaagaaaatgttagttttt

SEQ ID NO: 10659 - DNA, 1299 bp, Homo sapiens
tcttggaatcccttccattgtaaaaccattaatctgcaccatatacctatgctaggcactggcataagatgaagcacgttcttagagttcacatgctggtgattgtgccagacaatgagtaataaaataggtaacaatggctgtggaggaagtcagctgggttccagttatagtcgcatttcaggaaattatttaacagctgactttaacaacctaagcctcttctccatgtgtgcacacagggtagacctctgaagagtggcgctgtaatttctagggtaatggctgtgttaagtcaaggcaggatgacagttcaaacttctctcccagactgaattgcccacctcccaaaacccctcctacagaaaatttggagtcttcacttattccctggcagcccctacctaatagagtggtgaattatcaaacatgcaacaaaggatatggaaagtttagcaaaaacggcaacattttggaatgaatgaccgtaatgtgcgttctgcctgccaccctaactagcgcacattttgcaggtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaagatatggtaaataacggacgaggcggggccgcggttgctaagggcgcgggcatctggtggctgccataatggcttctgctcagtgcgggacgccaacttctgtcatgtaccggctgcgtctctggtccctatggcccctcctcacgtgacaactactgtgactactagtccaggaggctcagcctctggagtgggtccagggcccactccagctgacctccgaccccctgaggccaactgagccctgggcttggcgctcctccgatctccccccggaacctccctatgcgtttatccacccccacccccatacagacccgggagctttgataacctgaggtcctctactgccacccagatgtcagcctcgcctcaggaaccgactgagactttggttccatt

SEQ ID NO: 10660 - DNA, 1153 bp, Homo sapiens
ctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaatttgctgtacatgtttctacttaatatgtggcagtactttagtatttgccacttgtggacttgatgcttggccagtgttgatgttagaaaggatgaaggacagagatacagattgttgaagacaaaaatcttcctttgatgagaattgacaactgagaaaagcagttttccagtctttttcttttgaggagatactttaaatacttgctaccatcttactttcccatgagactttaattgctattattaaaggttccctaatacataatacaaagtacttcttaaattcagaggttcatattgacctagaagaataaaaacaaaacttggcagaatttcaaccaagggttgcccgataagtaattgctcaacatgtaagactgggctcagaaggctgcactgagagctaaccacattgtgggctgtttaaatgcatgtgaggttcagccttatctggtatccagtaacaaagtcactgtggtcttacagtttactcctgtcacagctgtgagtactaaaggagagagttccccccaggagtagc

SEQ ID NO: 10661 - DNA, 1187 bp, Homo sapiens
acacgacaggctcagagtcacttaggaagagaatcagcggcccgggataggaagtgactgttggggtcctgctggctggtgatgggctagtgagaagttctgggaaaaatcaccagcgccgggatgtggggagggaggcaacaagactgaattggttgaccaggaaggccaacccatctccttaaagggcccttcactggtgcgtgggtgaatgcggtccccggcctcctgggacctcgaggaacacaggacgcagccggtagtacggccagctcagctcgccgctcctctagccttgagggaggcgctgtgggggacagcctggcagccacgcatgcgcaaaacaccgtcaggaaggggccggggaggggcgggctcccgaacccggaagcgagggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggaggtgagcccgctgcggccccggccttggagagaggccggggaggcgagcccaggcgacgacccccagcagttgtggctcgtcctcgatgggatccaggatccccggaattttggggctgtgctgcgttccgcacacttcctcggagtggataaggtcatcaccagccggagaaacaggcacggacgtccctcattctctatgtgccccaacttg

SEQ ID NO: 10662 - DNA, 1472 bp, Homo sapiens
acaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacaca

SEQ ID NO: 10663 - DNA, 1151 bp, Homo sapiens
tctgtttagaaatgcctcgtgcttcaccattcctgtggtcatcatgacagcagctttaaaatttcatcttatttagccaatatattctaattttaactcttgttccatagatacaagcaatggctctcatgtcaaacttgaaaaaaaataaatagaaatccagcactccccctctctgaccagagaaatttaaatgtattctgcatcttcattggtccctttttatttacattgaaaatctaagctcggattattgtattggtagtaaatgtatgatttttttccctataacttagtaaaataagaattagtaggaagtaggaatagggagtgagcctggtaagtttgatgagagctaatgtgcattcagccagtgggtggaatttttgtgggctgaaggatttttaaagatgacttgcaagtccttcactcctagctcattctggttgagttagttgtaggaattagtacagtaggactactcctagagtccctcaccccatggtcctgagcatttgccttgctgctgcatgcctgtctttttggggactgtagtgccttttcactcctagagttttctttttgtctctttgtggaattgggattcttggtaagttaattacatcattttttcatggaggaaaaaaacatacatcttcatgctattttttatttcttcagaatgaagggaaactatctaccatacacctctgattaacaagagtgccactcattcagttatatgcctagctggttaactctaaagcgtatcacattttttagaatagccactttaaaaaatatgtaattatagggagagttcattgcctttgctaccctagaatagctagatggtagggaaacgagaaagatgcagttgagagggaaaaatatatatgttagtacaatgtaatacttcaacttcccccaagtgacaggtttcagctaagaaatgatacaatctatggcagcttgctaattttttttgtcagtcaaaagaaggaagaaagactatttagatgttttttttaatttaatgaaaggattgttaaatctcatttggataaagccaagactttctgtcagaaaagggtaatgatgaggagggtaggagaatctgtcagtttggacctagaatggggtggaatttg

SEQ ID NO: 10664 - DNA, 1321 bp, Homo sapiens
gaccctgtctcaaataaataaataataaaataaaagttatagcctctcaatatatagtgtttgaagccagatgagcattatgtagtttaaatattatttcaaacaaccattactctatccagacccttaccatttattcccccattactaacaaccaaaatatcaatatcacaacaagcagctttttcctactgcaaaggtttccccattgatcataattatttcctggacaccaccaaatgaaaatgagattaggaatgccttataggcttttgagaaaaatttctttgaggaaaagggaactggttttaatttatgggcatagttatcatgatctcaattttcctcccttgtagaaattaaaggccctgaaatagaatagccaaggaagttagttctcaaattgccttgcttccacgtctcagctatggtttattagatataacctctggctgacctcagatatagattattattcataacctgcctttctcacttttcattttctccatagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtaagagagagttcaatggtctacttatttaatctgtcttgttagttttgctgattatgttctgaaaagagcaaggatgatttcagctaagactgctttgccttttcctatgtcactgaactcaaagctttgttgaggaagtcagaaatgatgtatttttcagaaatcatgtatgttcccatcaaatttttcatgtcctactaggttttttttgtttttgtttttgttttttgagacggagtcttgctttgttgcccaagctggagtgcagtggtgcggtctcagctcactgcaacctccgcctcctgggttcaagcaattcttctgcctcagcctcccaagtagctgggattacaggcgcctgccaccatgcccagctaattttttgtgtttttagtagagatggagtttcaccatgttggccaggctggtcttgaactcctgaccttgtgatccgcccacctcagctttccaaaatgctgggattagaggtgtgagctaccccgcccagcctattttttttttttttttttgagatagagtctcactctgtc

SEQ ID NO: 10665 - DNA, 1206 bp, Homo sapiens
catatgaggttatgaataatgttcttccattttactaattgtaaaaaaaaaaaaatgctgaaaactcagggatccttacatttcccatgacacatttatgttttattttctctgtagtaatggaacggcggtatcccaaggaggtccaggacctgtatgaaacaatgaggcgatttgcaagaattgtggggccagtggaacatgacaaattcattgaaagccatgcatgtaggtggtttttgagccttgagcagtatttgtgtgtgtatatttatataaataggagagataatggtgtgttttatgtgaagttctataaataaataaatggatatttctctctttgttcccctttattaccatgagacaaatttgggactatgggggtggcagaagagaggttaaaaagccctaatgacttcccccattgccccagataaacaataatttagtagtttttctccctactttgtatcatgggaactttcaaatatatatagaagtagagataataatatgatgaactcccgtgtatccatcatccagcttcagcagttttcaacacatggccagtctggtttcatctttaccactcactcttccctcctgccctcaactggattattctgaagcaaatcccagacatcattttattttgttcataaatattttagtattaaaagtagttttaaaaatgaggacagagatggatagcttgtggagatagtacttccatcgatctcttgcctttctgtggtatttctgtgagagctctacatagttaccatttgatttttcactataaaaaattaaaagttgttatgaggccgggcgtggtggctcacacctgtaatcccagcactttgggaggccaaggcaagaggattgcttgagtcgaggagttcgagaccaatctgggcaacatagtaaaactccatctctacaaaaatacaaaagttagccaggcatggtagtgcacacctgtagtctcagctactttggaggctgaggtgggaggattgcttgaacccgggtagccgaggttgcggtgagctgagatcacaccactgcactccagcctgagcgacagagtgagaccctgtttcaaaacaaaatatgttggtatggcagtaaggcctagattgttaaaataatatggactctggcttgttctgtacctttcatcatgacatttgtgtatgtggc

SEQ ID NO: 10666 - DNA, 1396 bp, Homo sapiens
gttcttaaggcaactatgtattggaagcctggcatctttgattgtagcctagcctctggtgacttttgtgaggaaccaaatggttttatctccctttttgaggatttggaataatcccttatgccttttgttgatgtaacagagaagcctgttttccaccagtggagcttgtaacagtccctcccctttctctgccccacttgaaaagcaacctctataaaacttcgacattttctttgcttaactcagtctatccattcccagctgaataccaatccctaatacacattcaaaacaaaaccaaaaaagttttgctcatcaagcttcccctcctggccagtgacctcctacttgggtttctttctcaggtgtgtgagttgacctcagcccctgctttgccatataatggctcattgttcctgtttgtggatcttgcaggtaaacagggctactttggaaggaacagatattccctcacataataaaaaagaagggccttttgctggcctaacagtctttctttgatctgaaggcacacagtacttggttaattaccatgtttgccttgtactgctggccgagtggcaaggattagggaatgtctgttctgcagttattatttccattcgtcagctgtcaaagcaggcattgtgtgatgtttcttaactggatgacatctgggcatcagattttagagtctcctacatggttaggaagaaataggtgatagtcgggcatggtggcatatgcctgtcttcccaggtagttgggaggctgaggcaggaggatcacttgagccagggagattgaggctatagtgagctatgatcgcaacactgcactccagcctgagcaacagagtgagaccctgtctcaaaaataataataataaataagagataactactgtggtgagtagttacatttgatgctaaggtatgtgtgactgtatgtgtattttagcagattatgggtaattcatgtgccctgaatatgtaattcattttcaagtgaatgttcgggtgcccatgttgttagctaaacaggcctgagggaatgggacaggatttcctaagctggatatagtgatcctatacctaactggcctggctgcactgaactttttaatactttacacctgagaaattgtcactcctattaaatctatgctgtttcctttctctgtctataggtagacggagtgcaccacccttgaacctcactggcctccctggcacagagaagctgaatgaaaaagaaaaggaggtaacaaaagggagggggctgggagaaagagaataggggctgattattcattgagttgtcattaaaaatccattacagggtcaaaccccttttgtttcattcatctaacatatatgcacagctctggtga

SEQ ID NO: 10667 - DNA, 2243 bp, Homo sapiens
tgtgccccatggctcttccctgaccattggtgctgggactgtacctgggcatttagtgtttgactcctgaaagagccaggctgctcctcaggagcacatagttgtaaatccctaacaaacccaggcccctgagccagctggcatgtgctaaaggctcttctagtatcacaccctggctttctcttcctgggtgtgtgtccttagggagtgttctctccagagaggaagagactaaatggaatgtagtccagccacccatcagctcctataaatagttggaggttgatgtcactttaaaaaattttttgctatacctgctggattaaattacaaaaatgacagatgttaatgtttattaaatttgccgtgtcttgcagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcacctgtaatcccagcactttgggaggctaaggtgggcggatcacgaagtcaggagttcaagaccagcctgaccaacatggtgaaacagtctctactaaaaatacaaaaattagctgagtgtggtggcacacgcctgtaatcccagctactcaggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttgtgggtgtgtcaaatattctggtaactgaaacacacttaaggtgttggatgcctgccccatcacgctgcactgtctgctgtcacatgtgtcctgaactcaccctgtttttgccctgggtttcccaggataccaagcccctgaggatggagatgatgcaacaaacctcagctttgcttggattgtgacttgaaccctatttctcaatggtgaaaggctagcctgcaataaaagctgcttttaaaacagaagtaaagcagctttatatatgggactcactagatatgagggtaagtagccccaccacatgtaaaacttggtcctcaaacgtttctgcagaataagaagccaaacttatggttatcttgtttctgttagaaacaaagttgtatat

SEQ ID NO: 10668 - DNA, 1267 bp, Homo sapiens
agcctcgtgagtagctgggattacaggcgtgcaccaccacgcccagctaattttgtatttttagtagaggcaaggtttctccatgttggccaggcttgaactccggacctcaggcgatccgcccgcctcagcctcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgta

SEQ ID NO: 10669 - DNA, 1175 bp, Homo sapiens
ggaaagtaaatatacgtagaattttttattcaatttttcttactttgctctttacaggaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctca

SEQ ID NO: 10670 - DNA, 1204 bp, Homo sapiens
agtgagctacgatggtgcccctgccactccagcctgggcaacagaatgagaccctgtctgggtttgggggagaagttatttacaatgttttgaaaatatcctttggcccaggcatggtggctcacacctgtaatcccagcactttgggaggccgaggcaggtggatcacttgaggtcagaagtttgagaccagcctggccaacatggcaaaaccccatctctactaaaaatacaaaaattagccaggcatagtgatacatgcctgtaatcccagctactggtgaacactccagcctggtgacaaaacaagactttgtctcaaaaaaaaaaaaaaaaaaaaaaaaaagaaaggaaaagaaaatgaccctcagatataattctaatatcaccagttggcctttcttgacatctcttttagtcttctctctttttcagaaatgtgagttctttgccaaatgttttgaactgaattttaggtcattaaattgtgagttttggaatatagtggaagggacatgtgagtgttttagattagtagaatgacaatcatttcaatttctttaagtattttcatcttctgtttttaggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtgagccatactttctaaccattagcctatgactgctctcgtttacaatgaaatacgtaatttgttacatagatactttggactttgaaaagaagagaaaatagcatgggtgattttactggttcatatttctagtcttgaaaagctagtaagtctaagttctaattaaacatttcttttaaaggtaggcagtaaaaaaaaattggtctggccaggcgcagtggcttacgcctgtaatcctagcattttgggaggctgaggcgggtggatcacctgaggtcgggagtttgagaccagcctgaccaacatggagaaaccccgtctttactaaaaatacaaaattagctgggcacggtggcgcatgcctgtaatcccagctactcgggaggctgaggcaggagaatcacttgaacctgggaggcagaggttgcggtgagccgagatcgtgccat

SEQ ID NO: 10671 - DNA, 2399 bp, Homo sapiens
cctgaccaggcccgtccctccttcgccagtgctgtgcagagctcatttaaatgtattcctttctaggtctgggcgcggtggctcacgcctgtaatcccagcactttgggaggctgaggtgggtggatcatgaggtcgggagttcaagaccagcttggccaaacagtgaaaccctatctctactaaaatacaaaaattagctgggcatggtggcatgcgcctgtagtcccagctacttgggaggctgagacaggagaattgcttgaacccaggaggcggaggttgcactgagccgagattgcgccactgccctctagcctagacgacagagtgagactccatctcaaaaaaaataaataatttctttctggttgtattttcaagtcacaaattggaaaaggcttacatctagggacccactgttgattcctaagttgtgggtgggtgatatcagtggcctcagtgcctgcataaccctcacctgtttatgactgatctactgtaaccttcctcaggttgagagtgagctgctgtgagccagtgacaactactgctacaacttgctgttacttgaaattcgtgtgctatgttggtagcacaggagtaggcgggcgggggttttggtgtgggcactaggtaagtgggtggcaaccggctctttgggaccattggtgctgacctttgcctggtcacctgcctgtgcctaggccaagtgaatgttacatcttggaacctgagccatggaggtggcgccacctccctgaggagaaaggtgtggccaaaggaaactcctgcatggctcctgctccttccccttccctacatttcacttgggctaatgatgtaagccccccttgaggttggggatggtgtggagatagctgcagacacccctgtaacagacatccaggaagaattagggagtgggggtaattatagttcctaggtctaggggtgagaggtgggagtagaaccagaagtgccctggaatccagccgtgtcagccctcaccccagggcccccaggaaagcatggcctgcttgaagccctctgctccctgcagaaactggggcgaggaggagctttttccttcagttagatctttcccttccctgctgcctcgctcccttagctttggagccctaaagttagtggacaagacactgggataaagctctatggctgctggaaggaggtctgagtctgtgtgtgtgcatatgcatgcatgtgtgtgtgtgtgtgtgtcctcatttgcagaagtcttgctaccagttagggtgttaagagcatctccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttcttttcactgcagcagtgtttatcagtagttcaaaatgatttatttgctcctggggagtaaaaccttttttattaaaaaaagaaaaagaaaaaaaaaagaaagaaaagtgtgcccccctcctatgctgcgatagctataaaatgattgggtcacaaaggtcaagtctgcacgtccctgtggtagaccctgctttcacattggagccttcacactcagcacaaaatgattggaggccttgataaaatggagagcaaagtcttgggagcagtgaaatgggggttggatcatagagacaggcgctggggactcgggtactgcagttaggaaagtagcgttatgagttgtactgaaaatgttgattctctaatctgccagaaaaggacctgtcttttcatgcagatttcatattgtctttgtccttttcattgcttcttgaccttcctggcaggtgtcgctcagtttcttcctgtttcccttcctgtcctctccacacctgctatcccgtcccactcccatctacctcccgggaagccagccctgcatgctgagtttgtgacctgcttcattcccatttcatttctagagggtttagaggtgacctggaaccgttccctttccctctcctaccccctcctctgcaacaccaagaggcctggaggggcagacagaaagcagccagccacggcgggaagacatgcatgtttggttgcagctggactgcgatcgtagttcctcctggagatagagtgtgaggaacttaggacactcttcctcagactctgggatcatcacataccacactgccccgctcagagtttcgtcctgagctccctaaccagctcaggtggagcagaagcctgctctcactcctccatctctggtgctccct

SEQ ID NO: 10672 - DNA, 1909 bp, Homo sapiens
aggtgggcaaactccttctcacccctgtggctcaggagccagctccccattcccggggatggagggacagctgggctctgccagcctctgccccacccagacacacccctagccggctttcttctctcatctgccaccttgactggtctcggtggggttttccggctccacccgaggagctttgggcattggtggacataagggggcaggcaggcggtggaggccaggactgggggaggaccccaggaaacagatgctggaatgtttgtggctagggcagtccttgtcacagtcttagcgaaatcccacttttgctggagtttgcctgcgtctcaaaggcttcttgcttcttctttgttctctccctggacctgcccttccacccccacccacttatgcctctccctcgttccccccaccgcttggtcctctcccttcatttccctcctgggctccttgacctcctcgggctgccgttcccctaccctgtgggacttgtctggccctgcttacctgtctctgtgtctctggccaggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattggtgagtgatggtacatgtggctgtcctggaggacttagctgtcggctgtctgtgtcctgctgtaccccatctgcctgtctgccatgggcagaattcggctgggtgctggtgggatcatcttgtttctctgtcaattcattcatctgttcatccatccatccatctgttcttccatctttctttctgttctctgtcatcctttcttccat

SEQ ID NO: 10673 - DNA, 1235 bp, Homo sapiens
cttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatgagtcagctgtctcacttgttttggagggaaagggccagagtggggctgggagacaggagaggtacctggcccagggaaggagggcgatggggactggacc

SEQ ID NO: 10674 - DNA, 1167 bp, Homo sapiens
agcgtgagaggagctttgtgtgtgagaacatgtgtaatgtgtgtgcagacatgccgagagccagagacttgtgtgtgggccacgtacatgtggatagagacgcatacatggaggtgcatgtaatctgtgtctccgagtgtgtgtgtgcaggtatgtgtgctggtgcagacccaagtgtgtgggtgtgcctctgtgtgcgtgtgttccatcatccctgcaccactggctccagatcccttcctgagcccccgtccccgctggccctctcacagcctgcagcacatcagtgcccccagctgcatgcgcctcgctgctctgtccatcagtgtgtgcttgaccaagagaaaactaagacgtctcgggggacccctgtacctggtcctctcagcccccgcccactgtgctgtgttactcgcatgggggatttcctgccccttccacaatatgctgtttccccaggagcctcaggcctgaggctctgagtggggtccccagggggccccccggggtgagccccggctccacaccctgccccatccaccctgtagggcccatgttggtgtagcagtgatggcttctgtggatattctgtgacctctgtcggtgtaacttgacaatttctaaatggaaaagggttgctgtgttttctctgtctctcttttttaatgtccttttttcttctcccccgctccctgctctctttccttttcagtttttctagccaagtgtttggggctttaataaaacttgtttctttttcctctcctggatctccttcctataggctgatgtctcattatttctctgcttcaccctggaggatctggaaggtgctgggatgggtggggtggcaggtggggaatccctggcagccactggccttcagctggcagagcatgagggggaggacagaacagggcccctgggattagccaggtggggtggtgtacaccagtaatcccagctactcgggtggctgaggcatgagaatcgcttgaacccaggaggtggaggttgcagtgagccaagatcgcaccactgcgctccagcctggatgacagagcgagaacctgtctcaaaaaacaaaaacaaaacaaaaaaaaccagttctcagcttggcattccaggaggtgtcctgcctaaccctcacaaccatcggtgaggtag

SEQ ID NO: 10675 - DNA, 1195 bp, Homo sapiens
gcagttgtcatctggaaccagggccagctttggagaagacagcataggggctgaggggttagggaagagcccctgtcccacctgccactttcccctccattccgggcctgtccactcgggattttgctaacttgcctccagatattctaagccctctctcaggagccggagccaccccttccccttctacttcccacccctcacggtagctgagctgagggttacccctctggtgcctcttcatcggccaccttttcctccatgctaggaaccctgatgggaaagggaccctagacgcagcaggatggagggagggcagagagcagaagggacttcctaagcgtcagggaggagatgctggctcctcaagcaagggacaggggtgaccttggtgaccagccccgtggggttccgggctgtcttctgcgcagagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgc

SEQ ID NO: 10676 - DNA, 3497 bp, Homo sapiens
ctagaatccctgctgtgcaaagcttgtaaacaaccattgcctcatttcatctttcccctaaacattatttctgagattcatctacgttgattcacatagctcttttagtcccaagagggcagatatgaaccgtcccattttacagatgcaaaaccgtgactgctcgggaaaaaacgagtggctttgcgacgacgaaatcccaggacgccaccgggccacgtgcggcggcgcatctggccgctcgcgatcccacccgcgcacgctccctcccgcgctccctcccagccgccgccgcgccgggtccacgtgtgtgtgtctgtgtgcggaatggggacgggggcggtgccgccggaggggtggggtccgggctaacgtcacgggcggtgcggcccaatcagcggcgggctcgcggccccggcgctggtattggggcagcgagggggcagttctctataacgcggtctccgggagccagcggggaagaaagaaaccgagcgggcggaaggcgccctccccgccgcctgggcccgggcaccgggtgccgggcccggggtccttcccgcctcccgcggccgccggccgctttgtttcccctgcctctgcgcttcgggcgactcgagagggtctcccgccggggttgcgaaggggacgcggcggcagaagggcggccgaccccgccgggactcacagggacccaggagtccggccgccgggagggccgcgtgaggagagcgaagagggagcccgagctctgcggccccgggtggcgggccgggggcgcccgtgagcagagacctccccgtcgacggggggcgatgttcccctcacccgtgggctcttcgggcagccagggcatcccgccgctgggacctggacccgctcagtgggcacccctcaggctgctccatggagaccctgtgccctgcgccccgcctggcagtgccggcgtccccgcgagggtcgccctgctcccccacgccccggaagccgtgtcgggggacccaggaattctctccgctgtgcctgcgtgccctcgccttctgcgcccttgccaagccccgggcgtcctctctgggcccggggcctggggagctggcggcgcggtccccagtgctgcggggccctcaggcccccctgcgccctggcggctgggccccggatggcctgaagcacctctgggcaccgaccgggcggcccggcgttcctaacaccgccgccggcgaggatgcggacgtcgcagcgtgcccccgccgcggagaggaggaagagggcggaggcggtttcccgcacttcggcgttcgctcctgtgcacctccgggccgctgccctgcgcccccgcaccctcgggaatctacgaccagcttcgcctcggccccgcctcgcccggccccgggtctcgagcctcagcgtggcccagccgccagcccgcctcaggaacccagttcccggcctccgtcgccacctgcgggcctctccaccgagcccgcgggtcccgggacggcgccgcggccgttcctgcccggccagcctgccgaagtcgatggaaaccccccgccggccgcccccgaggctccagcggccagcccctcgacggccagcccggctccggccgcacccggagatctccgccaggaacatttcgatcgtctgatccgccggtcgaaactttggtgttacgcgaagggcttcgccttggacactccgagtttgcgccgggggccagagcggccgcctgcgaaagggccggctcggggagccgccaagaaacgccggctgccggcgccccctccgcgcaccgcgcagccccgccgccctgcaccgacgctccccaccacgagcaccttcagcctcctcaactgcttcccctgccccccggccctggtggtgggggaagacggagacctaaagccggcatcctcgcttcgcctccagggagactctaagcccccgcccgcccacccgctgtggaggtggcagatggggggtcccgctgtccctgagccccctggcctcaaattctgggggatcaacatggatgaaagctgaccgtgggacttctgccaaaggggaaaagttgggaccatggccaaaccgcgggcttgaggagggagccccgtttctcacatttgtccccttcctttacattttaggagctgtgggcagagggacctaaataacagtgatcttcattcaagcacctaagttttcggggtgacagtccctccccctcatcctttgcagaggaacccagggctggagtcgggagaaggctgatgacatagattccaatccctgcctccttccatctcggaccgttggaggcagggcctgcaccccagtgggagcaaaggaggccaccgctcaaagacacccccccacccaaaaaaaaggggagaagagagagacctcggtgatggacaaaccggttgttactgtgtctgtgggcgagcctggggtgcggggctgtggtgggggtggggagatgattggcagctccctgggggcatcccccacccccactgtccaggcctttaaccctttgctcccctcaggccttccctaacgctccaagcaccgctggagcctttaatgggtgagggaacttgggtaagaggaagatcacccccttcctgtcccctttctaggccccctcaagtgcaggtgacccttaattggtgagatcttcagcctcagccgccgacctttcccttttgtccagttttggagttcccgttttttccttgtttgctttccgagtgtaaggtctggccggtgagaaagatttcccccaaccttgattaatcagccccctcccccaacttacttcccttaggacgggtagggctgagggacctcctctcctggaaagtgcttactttgcctggggaaggggctagacactgtcccagggaaagtaatagaaggtggaagaaatcaataaaatcagaccaaacaagtcgcctttcgagggcctccaccgatttatggatgagagggggtggaggtggaaggcaggcccaagtccattctttggacacccaaactcagcccccttaaagagtggaaacaaaacaagctgcactttgcagaggtggtaaatgaaaggactcttggcctaacttcaagagtcccctggggtttgaaggggcaaagtttgagtctggatggaacctgggctgaggtaccttaagcttccccccgcaacaccccagcctcagggattgcgggagttgtcagagatctgatggatccgaaaggggcagggccaggggattaggtttggggtcagaggttctgttttccaggggaggggtgagataggcctggatcatgccctctgccatgccctccagctaggaggatcttgagtcagagaggattggaagtgctttctcctccacccaggtgaggtcaggggagcttaggtcttagggagatggcaagttgaggtatgaagggaagctggggcttttggagctgccgaacaactgagggac

SEQ ID NO: 10677 - DNA, 1233 bp, Homo sapiens
tgtgtgccctctacatccccgaggtgcaatttgccaacgtgctcaccatggagcccatcgtgctgcagtacgtgcctcatgatcgcttcaacaaggtcagcggccccccgccgtgtcccctaccagttccctcccatctatgggttcctccaacgctctcttcatccggtgtaatttgattctgtccaacgagcactgaaagggaacttgggaggtgggtaggtacctaccagtgaaccacccttctgttgacagacacactcatgctctggcactcaggtgaaatagtaggctcccctgcagtagttctgccagagggtagaccttcgcagttacttcattcattcattcgctggacacattttattaagtgcctactatgtgccagacctggtgcaaggtagctggcacacgctgttcggtgctgatcaagacaggtgtgctgcccgctcaatggaacgcaagttcttgcatgcgaagactataaatatcagtaaaaaggcaaagtaaatgcaatttgtgataaatgctgtgaagaaaataagacactaaaataaagacctggtgggggcttactttagaccagatggtaaaggaaggagacatttaggctgagacctggggcgtgagaaggagccagcttccaggagggtaagggcccccaggttccaggcagaagaaagcctgggcagaggcacagaggtgggcataagctccctagtgagcaagacagacaaaggccttggcctttcagagctaaccatccaaggactgtgctacccagcatagtagccatcggccacacgtggctacataaattaatcaaaattaaaagcaggctgggtgtggtggctcacacctgtaatcccagactttgggaggctgaggggggtggatcacctaaggtcaggagtttgagaccggcctggtcaacatgatgagaccccatctctagaaaaatacaaaaattagctgggcatggtggtgggcacctgcagtcccagctactcgggaggttgaggcaggagaatccctggaacccaggaggcggaggaggttgcagtgagccgagatcgtgccactgcactccaacctgggcgacagagggagactccgtctcaaataaataaataaaaataaacaacaattaaatacagtttagaatctagttcctcagtcacgctagccatagttcaagtgcttatagcccatgtgactggtggcatttgtctt

SEQ ID NO: 10678 - DNA, 1143 bp, Homo sapiens
tttggggtagtagctggagggctccaggatggcaccagagaagcccattctcctgtgggtcctcttctctgcctcgccacttccagcataggtcccgccttcttagacgccctaagtattcagtgaatgaatggaccaatgagtaaatctcttcagactctgggactgttttcatctccctcttggcttccatcttccctgcctaaggtgaaagacagacaccttcttgggttcagtgaattcccctctgccttacacccaggagtgccacagctgcctccccatatccctggtctaggagctcctggccactccctgcccggaagtccttcatgaaactagctgtgggctctcccagttgagctaggtcctgtgccctcctgcttcactcccacatcaggatcagcacaggcccaggcacctggtgttgaaccttcctctctcctctccttcaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcaggtgagtgtgggcatccgggaggaagctgggagcagggaaagccttttgtcctgagcttttctggcaagggactttgcatattggttttgcatctcatttacttctccattggttcaggataaagatggggaatcccctcctctccaaacctgcccccaaacccttccttcttgaaccagaactctcctctccccttcaggggccaccccaccaacctcataacagtattccttatcccctacatttgtgctgcaaggtacaatttttcaagaacccccattaacattttctcctataatcgctacagtcatctggtgaggccagtagggtgcgagttactctcccccattttattacaggtgggaaagctggaggggtcgggggtactcatcccaggacacagacagtggcagagctgagacaggaaaccaggcatccccattcgtggaccagagctctctcccgccagta

SEQ ID NO: 10679 - DNA, 1159 bp, Homo sapiens
tggggacagagggcatttcagggcccagccagtctagtgaggaacagagcttacacatgcacttagaaggaaatgggatggataccactccaaaagatagagcacggaggagacagtcaccttcaggacatccccctctgcatgcgtggagtagaaaggattggggacagattgtcagaaggttttaccaagttttgggagggagattagaaaagctaggaattctgtagccctcggcagggcagtttaacaagcaggcgcagcaagcagatgtcacccaggcaggaagtgacatctttgcagcaagagggttagactggggcatgtagccagatcccggggagcactcgagctggggaggggctgtcagccacctggctgagcaggagtctggggtggagagtaaccacgtgcttccctctgtccttgtgcctgcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgagacctgactcctgggctcctccttccctgggcaggttggggacagactgacagaggaccccagccttccatgggaattggagcaactgggctgagttgccatcagaccaccctccgggctctggacccctctgctccccagcacacccggccccctgcaccccggtacacacagttgtgctctagatccaagaataaccgccaggggattctacctccctcccttaggtgttttctctggctggctctacctttagcctcccttctacccacatctttggaacccccatgggtgccgttaatcccctcctctcccaagctgagagcagccacacaggtatgtgaatatctgatcccctctcccctttcttcccaaaggtcggacacccatcacctgcatgtgaccccagaaagaatgggagagctttctggctgccccctccctctggccattgccctccctgcaaaaacaaacaggccgggtgtggtggctcacgcctgtaatcccagcactttgggaggccgaggcgggtgga

SEQ ID NO: 10680 - DNA, 3366 bp, Homo sapiens
cccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgagg

SEQ ID NO: 10681 - DNA, 1220 bp, Homo sapiens
ctgaggaaggtagcacgcaaacccttgccctaaagagccaacgcgcccacgtgtctgctgggaatccttaggtcacagagggcctacctcgcaggggcgactgggcgcggggcatcagcccagaagttcatttcaaggactcacatctgaaatctcagttctttcttgaaatggctgaaattttatgccctgaagacgcggacaccccttgtttgcactgtgggcttggcagcaggggggtgggactcagaggcatcttgaacacgctggcttttgtcccccactccatcggggagcttgggactcagggctgaccttctgcattgtacatgacactggcctgtctcacacaagatccagcttccctcaacagtgcacaaggacaggtaccacacgtgcagaacacacatcgccacattgggcctcggagcagggacagggtggaggaggagggatatctgagtctgagcagagggcggggaggctggtcctggagttggaagttggctctgactctcctctctctctccacacccccaagtctgcaaaacctgcatcgtgcgctacctggagaccaacaaatactgccccatgtgtgacgtgcaggtccataaaacccggccgctgctgagcatcaggtgggcttggcacggcacctcctgtccccgcgatcctctgggtcagcctcccccatccctcccacgctccgtgcttccttcagccaaggcggcaggtgtaggagaagcatggggtgtggacctgggctactccccgaccttggggttacatttggctcatcacagggtgaggcatactagaggggcaaagaccagacccacagggatcctaatgcctgggcaccggtctcaggaagggggtgggaagaggggtaccctggctgggagagcagggcgaggtcggagcgctctggagaaggcattgctgataagccctgtccatttttccccaggtctgacaaaacacttcaagacattgtctacaaattggtccctgggctttttaaaggtatctgcactccattcctcctccactgaccccatttcccaacccatggccctgtcctcatcctgctgccttcttccagatgagatgaaacggcggcgggatttctatgcagcgtaccccctgacggagggtgagtgtgctcgcgtctgtttgtgtgtgcacagtcttgcctgggaccatgtaggtgtgtagcg

SEQ ID NO: 10682 - DNA, 1172 bp, Homo sapiens
gaggtcctgagcaaagacagtggcagtggggaggcaggaaggcagctgtcaaggggacttagtcacttaaaacagaagcgaaggatgtagagacagaggatggctgggttctccagctaggctagccaagacagaatgtagaaggaacaggtttgggggaagtgggtttgtggttggacaggttgggttttgaggtacctgttaagatatccaggatcagagcccatcagacagctgctaaagcacactggagctaaatagggattcttctccctattttacagagaaactgaggctcagtgaagagagacatactatttgcccaatgtcacactgctgattagtaaaagaaattcagggcttgaagtctctttcactttcctttacataattctgcttccttccaaggaaggagctgagaggggcttcccacatcctgggaatcatcccttacttcaggcatgtcttggggccagagctgggaatcttgagcctagaaaaaagagagttaagggaccagaccaaatcagagccagaggctgtggtttgaaggggttccactctgttggcaggatccggatcacctgtttgaaaccatctcccaagccatgctgaatgctgtggaccgggatgcagtgtcaggcatgggagtcattgtccacatcatgtgagtatgggctgggagaagtctagaagctctgcagacaccctgcctctctcccttctccacgagcatacaccccattttcccagccccctggtcaggtgtgagataagaaaggtgcttttggcagtcctgggtgagcaaaagtccatgcctccctatggctggtaactggcagcctacccagcttcctctggcctcttgtcaggtgaggttctgtgaccccgtgctcacaagagacatttcttccttaacaatgtctccgaagtctcagggatccgtgttggggtgagccacaacaaagctactgcagatggattgaaattctaggtggctcgcatcctctctccagcccagatctgtgtgatgttctgagctctagagaccaatttccaagcctcagccaactccctaagtgccatcctccttgtccttttacttgtttggggccatcaccaggaacctgattggatagagtaggaggtatccttccaaccactttcctaca

SEQ ID NO: 10683 - DNA, 2114 bp, Homo sapiens
tttgagctgtggtttggtggattttcaatttttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcattgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtacatctgttatgtgtgagtccttgggaaatgaaccttttttttttcttcccagaattaaaaagttttggtcctagctttagaggcagcttcggctaaatcaatgtatggcttgagtttggagaaagaatatggtcaatgacatcccgctttcagatgcaattaataaacagtggttaaaagcacagcaccactggctgggtttggtggctcacgcccagtacttggggaggccaaggcaggaggatcacttgagcccagaagttcagtaccggtctgggtaacatagtgagaccccgtctctacaaaacaagaattagctggatgtgatggcacatgtctgtagtcccagctactcaggaggctgaggcaggaggatca

SEQ ID NO: 10684 - DNA, 1217 bp, Homo sapiens
attttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgc

SEQ ID NO: 10685 - DNA, 1192 bp, Homo sapiens
ggagtcagaaacaactcctgtcggccatcctgtccctcgcccaccccagcccctagcccagctcccagacatgccgtctgtcaacatgaaatgccgtgtgtcatgaatcacctgtctgtccttgtgctaggcctagaccttggtctctggtcttttacctctgccctcactacgttcttcatagtcctgctgggatggcagacatttctatctcatagtccagcctgagtcagtcagtggctgcctgagccctgagctggtccaggctcaacaggaaagaatcctttagtcattcctcatctttcatgtgtttgccctccctgcccacccaaagcctgggactagaggctcctgcactgctgatttagcaggttgagggtcggtacactgacaacccctccttcccctttctgtatagttgctcccggcagaacagttgggtgtccctggggtgaattaatcaggcttacccagcctaactgctgttgctctcctaggccaaggacttgccaacattcaaagacaatgacttcctcaatgaagggcagaagctgcatgtgggagaggagagtaaaaagaacttcctggagaaactgaagcgggacgttgaggtacttactaaccttcattttcacctgcaaggctccttctgtacctagagtaggcgcctcttaaaccttaagaagaatggaattcagtactttccaggagtatggacaaaagggtggtgatttgagcagcgtgggcacttatgggcacctaaagcaagtgcaaatgatcattccacctgacggagcatagttggcgccagtaggacctttgtaatttagtttagaatgcttttcccttttcactaattcattccaacacctttttcaaactcccttctgctgttgtccctacaatggagagggcatctggccatcagagctgtaggaacccagctattaaggtcctgtaaccccaacattttgggaggctgaggtgggaggatcgcttgagctcagcagttcaataccagcctaggcaacatagcaagacctcatctctactaaaaattaaaaaatttagccaggcgtaggggcacacacctgtagtcccagctacttgggaggctgaggcgaaaggattgtttgagcccgggagatgaggctgcagtgagctgtggtctcaccactacactccagcctgg

SEQ ID NO: 10686 - DNA, 1104 bp, Homo sapiens
ctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccc

SEQ ID NO: 10687 - DNA, 1652 bp, Homo sapiens
ggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcggacttggtttcctctctggctctgagctgctgttgtgtgtgtctgtgtgtgggtgtgtgtctctagctgtaaggtgctgctgtgtgtgtgtgtgtctagctgtaaggtgccactgtgtgtgtgtgtgtgtgtgtgtcctgtctgcttgggggcactggcctgtggccctcctgggacctctgctgcccctcggggagagaatgacttgtctggatgccaagggggagtttgctgctgtctgtcagg

SEQ ID NO: 10688 - DNA, 1096 bp, Homo sapiens
agttcctgtcccaggctttgcccggccgccccaggaacccaaccctctgggctgacctttctcctgcttctctccaggctctgcaggggacagggcaggtgctgcaggagcccctttgctggctttatctgctcccttgttctggacacagagccctgggaaaaagagggggtggaagacagacaaggaaggtggaatgttctgttttggccaccaggaaatggggtggggtgggcatacacagagaggacccctctcttaatacagctgcttttctcggtgccaacctccctcccccaagctcagatcctcctcttatgcccttgattgtgccagcccatgccacccccatcctgggcacagttacaccctcccatgcagtgggagaaacacagaccctcgtacccaaaggcccctgccccacttctcccccacaaagcggggtctcaagccacactgccctgtttgctgccatgaggcccccccccccagcaatatcccaggggcgggcccaatgcccactgtacatgaggctgcatgatgggtctggggccttgctgattccccagacccctaattaaatgtttcttgtcccagcccatctgctctgtgtctctcactgggacagaggaaggaaaggggcagggaagtggggagtggggtctggggatgctgagaggggcaaggctgagggtggaagaattcctccgtctctgaaaggaggggtgctgggcaggcggcaacatggcaggggtcccaggcctcatccctttcctccagcagcccgaggagggtggggtctggggagagccaaaaggggacctgaggaaagtgggaggaggtctggggacgctggagggaaacggcttggggctgcggtcactttccgcctccatgtgcacctgagtcgcgcaggggcggacatgctcctgcgcgccagggccgtcgaggccgatcttgcccacccagaggtgccctccgagaccgggcgtgccgggggtctgggagggctcagtacccatccgaggtcagcctcgtccccgcagtcccccaagccggagacagaaacgctggcggcggggacagtcgtggcccg

SEQ ID NO: 10689 - DNA, 1621 bp, Homo sapiens
tttagacgcatcaattcagtgtctctgaagcctttgatcgttaggaaggtcagtacataacctcttaggtgaagctgagttgatctttggagcccaagagagttaattttcaggagaaaaagaattagggcaagctcccctgtgggatgttaagagaaagtccatatgcgcttcttccatctctgcctcttgtttttaaataagtgcttgtgaagttcagtttatagaggttgagtctcagtgcttcctcagccagggtggtttattgctgttttacaaagaaccatgaacaagcaaaatcctatcaatagtcctttctgttttatgttttatagtcttattttgaagaatcggcatggtaaaatgatagacaagtttcaaataaagcagataattagctctagaattggggtactttgcctcaggtacagcatctgtcttgaatacatagtgatggctgtgtcacacatgggtacatttactttcctctctgatcaactgcacccctttttactggcaaagagggctcctactttctacacacttaaccagtcaaacagataggttttggcaccaccgaaagaaccacaagtgcaccccagctgcatctgggcatggttttggtactaggactagagaagtgagcagtaaatgacagtccttaccctaggaagagatgggagaagagaggtgtccagacatatttaccttttctcttctgtcatgccccaagaaccaaggatcatctttgaagtgacgtcttttttgttaaattggaagaagaaaactttgcagccaggcgtggtggctcacgcctgtaatcccagcactttgggaggccgaggcgggcggatcacaaagtgtcaggagtttgagaacagcctggccaacatggtgaaaccccatctctactgaaaatacaaaatcccagctacttgggaggctgaggcaagagaatcacttgaacctgggaggcggatgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaacccttacagcctgttggcacatacacaagatccacgagaccatgctcctcagaagctacccatgtcctttctcaccatggtgtggctcttggagc

SEQ ID NO: 10690 - DNA, 1229 bp, Homo sapiens
gggacttgctctggtgatctctgctattaaggcaaattccagcctgtttgtgccaagaacagagtcaagtgagagagaatgaagactcagagatgtgcagcactggcttgtatgttgtcaggcagaagccttgttcctttctcaagaaaacttcaggcctatcaagcttggaaggaaatacatttttttatgctgatttgcagcctacaccagctgatgaatatgctaggactttgagagaacacaaagcatggtaagttttggtcaggtggaaaggagcctgacatctgaacataatgcttcctctctcaacatctgggatacttttgaaaattcagtaaggcttaatgtaggaaaaattctttacaggaaaagctaattgatctgtttgtctaacctcatagccactccaaaatatgccttttataatggaaaaaaacagtgaacagagagaagagatttggggataagttagaaggtaccctcaaaactactgccgtaaacctacaggtgggcaaggaggaattactgtagtgtctctggagaaagttcttgaacatccaaatcatctcttttctaagcagtttttcccctaatctcataccttacatcttccagcatcatttgctacatcaatgtcttttcatcctcttcatcagccccattgagctgactccagcttatttttgcactgatttccaccatttccttcccacacccatcctttccctctatttaaagcctccatctcaccctcagtaatgctgctgatttactctcagatgtctcaagtctagcttcctttttgaatccttctcctactccaggggctgtcaaaggcagccttaaagttcagtgactgttaggtggctcaggccatttttcattgggtggtctttggtgtttgcatactgaatttgaattcagtttaaaagcaaactgttggatatgaggaagaaagggatatggccttagccctttttccaatatttggaatatgaaagcatattgtgctttgtgtaaaaaatgttttcttctcctattctgctcttgtctttactgaaggtaaaagtattccttaagtagcttttgcaaatttctagtctgatttccacattcattaagttgatttagcagacatgtaagtcagaagtttcacatatcccttgtatcaaacattttatagggaaacctagtaaatttatgatgcttcattttgggctttccag

SEQ ID NO: 10691 - DNA, 1171 bp, Homo sapiens
ctgggttaaaaaaaaaaagccaggtgattcctttgtgtgttatgtcgtaagtggagtgacttcatcatatatggaagaagatttctatattcagctttttctgcaggttggagtcagcatagagttggaaaatcagctttggctttctttcctgtctcatttcctctagtgttctcctttttattgtcatcagctctcaacaactctgccacttttgtgtcccaaggtaataagatgtaggaaacaaaacattgtaaagtggagcaagaaaagttatcaattaaccacatcagagtcaaatgtcttgggtgacactaaggaggatatgggcaggtgataccagagtgctttatcttgtgatgttgatacagtagcagcctctcagacattcagccaggttggatttctcatgagtttgtcacctagttttgaatcctatcccgttggtttctgcaggaaaaaaaaaaaaatttatgtggtttttaaaatttgttctgagtggggagaatcttagggggaatgtactgaatagtatcatgggctcagctcccccatgcagggccaacaaataccaaaatgagtaaactgggaagcttttctctctttctgtcttcatcccagatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtgactcttgaaagattttctttcttcaggcctagatcagaaaattaagtgcagc

SEQ ID NO: 10692 - DNA, 1177 bp, Homo sapiens
tacctgaaaactgcttactgcaaaactctgatgttatatctaaatctcaggtctcattcagcagctattgcaatgttaactttgttttcttctttattttgcagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatt

SEQ ID NO: 10693 - DNA, 1231 bp, Homo sapiens
gggcattaagagggaaaatctgtctcaaaaaaaaaaaaggtgtttgggtttttcatttttatatcaagtcagaatccaacccttccaccctcttttttttgaaggaccccttccttctcctcaatcaccagtgccaacagtgttgatcttcctgcctgtttcttcttgaaatttccccagccaatcccagtatctagagcatttgttcagaaactgcagaactgcacaggtgagttttgagcatcaggatctagtacttgttataaatgtgaaaaagaaacttcaaagtcaggttatcatgacgtctttcagtcttacatgcctcattgaagtattactggtaaagatgttatagtgctttgtactagtaaatgcttagtaagtactcttttgggtgaatgaatgtagatatcaaggggaaactgagctgtcagtgttttcatcttaacatgatcattatattgattcttgtttttccaggaattccattgtttgaaactcaaccaacttatgcacccctgtatgaactgatcactcagtttgagctatcaaaggaccctgaccccatacctttgaatcacaacatgagattttatgctgtaagtaaagccctagggagctagaatgttgtaggttatgtttggacccaagatcataatcttcctttatagcattattgaggtcagataagtttcttcaagactgctggatcatgtcctatttctttagtaaggcaggaaattacagaaatctcagaaatgggctgggcgcggtggctcacacctgtaatccccgcactttaggaggccaaggcaggcggatcgtgaggtcaggagttcgagaccagcctggccaacatagggaaaccctgtctctactaaaaatacaaaaaattagccgtgtgtggtggcgggtgcctgtaatcccagctactcgggaggctgagggaggagaatggcttgaatctgggaggcagaggttgcagtgagacaagattgtgccattgtgctccagcctgggtgacagagcgagactctgtctcaaaaaaaaaaaaaaaaaaaagaaatctcggaaatgtattgaagtaaaagggcatgagcttccattaggaaacaacaatgtacagttctttgttgaaattttgggtgattggccaggtgcagtggctcacacctgtaatcccaggaatttgggaggccaaggcgggtggtcactagagatcaggagtttg

SEQ ID NO: 10694 - DNA, 1240 bp, Homo sapiens
ccggcgcccgggcctgaggactggctcggcggagggagaagaggaaacagacttgagcagctccccgttgtctcgcaactccactgccgaggaactctcatttcttccctcgctccttcaccccccacctcatgtagaagggtgctgaggcgtcgggagggaggaggagcctgggctaccgtccctgccctccccacccccttcccggggcgctttggtgggcgtggagttggggttgggggggtgggtgggggttgctttttggagtgctggggaacttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcg

SEQ ID NO: 10695 - DNA, 2022 bp, Homo sapiens
gtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctctctctctctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcattgtattttggttatcagcagtcatcaataatgtttttccctcccctctcccacctcttatttttaattatgccaaatatcctaaataatatacttaagcctccattccctcatccctactagggaagggggtgagtgtatgtgtgagtgtatgtgtatgtatgatcccatctcacccccacccccattttgggagtcttttaaaatgaaaacaaagtttggtagttttgactatttctaaaagcagaggagaaaaaaaaacttatttaaatatcctggaatctgtatggaggaagaaaaggtatttgttaatttttcagttacgttatctataaacatgatggaagtaaaggtttggcagaatttcaccttgactatttgaaaattacagacccaattaattccattcaaaagtggttttcgttttgttttaattattgt

SEQ ID NO: 10696 - DNA, 1207 bp, Homo sapiens
tggggaattgcttaaggagctacaaatgggtctccagtgggattgatgggggacttgaaggcgggggacccctttggaggaactcctgacttctgcctatgttctcagtgtaccatttatctgttgatttcttaccaggtgcctttgagatagagataaatggacagctggtgttctccaagctggagaatgggggctttccctatgagaaagatgtgagtatttacagcgttgggaggacctcttggtcaccctaccccaacagtgcatcatcctgtcattccactcctctagctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaatgctaactagtgtgtgtttttatacgtccagtctgggaatgtggggggcacagaagtccggtcagcccagcctttgcaccgccagggtggctgtgctggctgggtgggctttctggacagctactccttaggtcagtgagctcctctggcatagccaaggcaaggaaaatgagtcccacagtagaccctgcctcgtctttcccccaccctacccaccactctcctcactcacaaggaggaaataaccccattctggtgagtggccttaggaattagttcgttctaaataagaatgatctggtcgtcaaagggctctcagatctgaatccagcttcccgatctcccccaaccctgaagctggagaactggatgtctggctcctcatccaagctttctgaagattcccagccactccctccaggaaaagaggaattgagtgtaaggtgagcaggaagggatggca

SEQ ID NO: 10697 - DNA, 1681 bp, Homo sapiens
acttctgtgccccccacattcccagactggacgtataaaaacacacactagttagcattagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatggcctcaatgagctagaggagtggaatgacaggatgatgcactgttggggtagggtgaccaagaggtcctcccaacgctgtaaatactcacatctttctcatagggaaagcccccattctccagcttggagaacaccagctgtccatttatctctatctcaaaggcacctggtaagaaatcaacagataaatggtacactgagaacataggcagaagtcaggagttcctccaaaggggtcccccgccttcaagtcccccatcaatcccactggagacccatttgtagctccttaagcaattccccaaccctgggtcaactccagggaacctgagggaggcctcgcctgtgtgcccctcgcaacactcaataaaggactccctcccctccaaccctacacgattgcagtctaataggtttttccccacaggcctctgtgacaccccctgacctatggaagggaactcatgttggccggacattttaccatgtgccaggcactgcgggcactttacataaagcagccaatgtcagaactagaaagcgggagagctgggattcagagcacagactgacccagcaggtgttctgcgagcctcacctgtgcccccgaggcgcgactcgatctcgatgcccggatactgctccttcacagcactggccagctccaggtaggtcgcctcgaagccgcagggttcactggggagtcaagagatggggctgggctggggattcgggggtggggcctcccgtggacccacctccgtccggcccgcgggaccagggtgcgggtcctccagccggggccgctcaccagtactccaccacgatgcggaccccactgcccggctcgacctcctcgggagggggcgctacggacgtctgccccggctccccgctcatcgcggccggctccgctcgggcccctgcttccgggtgtgacgcgaaccgcgggcacgtgacggggcggggcctctggagcggggaggggccgagggtggcgttcgggcgccccctgcgggtctccgccactgctacgttttgacctcgtagggcagctccggagctcgctccccgggcaggggctgggtccggtccagaccctccttccctggcccggtctcccggagtgccgggcttccccactccccactcccggtgtccgctggacttcatggcttcattta

SEQ ID NO: 10698 - DNA, 1657 bp, Homo sapiens
tgagtgcctgggctacaggaagacaccagcaggcagggcaaggcctggaggaccccagggcccagccatgcttattaaccctgccgtggctcctggtgtagggatgaacagaggaagttggaatattcctgggtcttacactggactcaggctttgggcctccctggccccatctttcctccattggagcttccttcctgctagtgagataggcctacaggcttggggtgaagctgggaggtgggggcggtactgggccaggaggggcccctttagcctgagagctcttgcttcttacgctggtctgggaacctcttctgtaactccttagctgttgggattctgcctttcccctcccaggaagtgagggaggaaggggtcctcccaacagtcttttatatctctccccacccttcccctcccaggtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgt

SEQ ID NO: 10699 - DNA, 1416 bp, Homo sapiens
cgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgctttgtgcatcagttactatacttcactgcagtattggcaggctcagattttgggttttttggccttagagtactagccccaggtgtgtaatctgagggcgatgggtctgcagatggggaggtgcccaggggaggatgaagggaccctgacctggggtcgggggcctaggtttactctcttttcgtacttgtgtggctttggtaaggtcttgttaggaaaggtgtaccatgtgtccatcaccagctgcagaccttcatctcccaatacacctcatggtgcttcacggttattgcagtttttacaaattgaaggtttggccaggcatggtggctcatgcctgtaatcccaacactttgggaggctaaggtgggcggatcactaaaggtcaggagtttgagaccagcctggccaacatggcaaaaccccgtctctactaaaaataaaaaaatcagctgggcatggaggcaggcgcctgtaatcccagctacttgggaggctgaagcaggagaattgcttgaacc

SEQ ID NO: 10700 - DNA, 1190 bp, Homo sapiens
caagcacccctcgcctggtgccaccctgggagactgggctttggggagcccagtcagacacagaaagctcctggggcacctctcactgtccccctttttctggaaccctttgccaggctggccgtgtggtgtgccctcagttcctactcctcccacaagggacaggcgtccacccgccagaagaagagacaccgcgaagacattgaggtaggccccccagctgccctcgccggcttcacttgttcaccggtttgttacagcatttcctaaggattccccaggcaaagggaagcagttgtggcccctgcccttggggcagctgtgcctgggcatgattggtcaggaatctgcatgggtgatttgtgtggccccagcttgcccatgggcacaaggggcctgtcagattgtgggaggggttgagcagagaggggctgaggccctgctagccatgctgacctcgctcaaatcggagctcaagctcttttccctgacagctggaaactggggggtttaggggtgtataacagtgactttcactccctctaggattatatcagcctcttccccctggacgatgtgcagccttcgaagttgatgcgactgctgagctctaatgaggacgatgccaacatcctttcgagccccagtgagtgtgtgggctggccgcgcgccgctccttttcctgggaattcactccccgatgctgccactctgccgctgccccagctgcaggcatctttgcagctggtcagagagggtgtggcagggacctgctgttctagcccccaagggggtgctctgtgtcctgcccctggagaagaggttgctgttctcactccctgagggttgaagctcctctgcccaggtccagcccagcccacagttgttcccccacagccctcctgcccctcccttaccccagggttgaggggatgacaagctacccaagtgagtgagttcactgcctcaggcacagcctgtgccattgactcaccagctctgaccttccttccttccttcccccaaaacatgcccggagaggcccgggctggggcatggggctactccccaccttcctgcctaaagagcacaccccccaccaaccacttccctggaggtcatccttttcactgtcccctcctccctgccaggcttactgccaagggttccttctgtggcatttttcctgt

SEQ ID NO: 10701 - DNA, 2453 bp, Homo sapiens
tgtaactaatatatggtgataaatagcttatcagctgcttttctttacacagaacctggatgacagtgtgttttcgaagcggcatgcaaaactggagctggatgagaagagaaggaaaaggtgaggccagagatgtccatcctggaaacaactgagccctaggacctaggacagagtatcagggaacctgacctccctttttcatgctgtggagaatcttggagtgcttaacactcttacattactggcttcccagttggttgaatatcttagttggaaatggtagttgttgcggtaaacatgtttggcctctttttgtgtatgaccttcctcaattctactttctgtggaacaccaacacatgatctaaacggtagacctaaacagctctcccttaacaaggcagtcatttctctttaccctgtctagaggagtcagcaagggtcttcctagcatctggattgtgtgagttgcttttatagagcaggttttgggtaaacagtaatgttgggtttctttgttttgtttggtttgtttttcccagatgggatattcagaggatcagggaacaaagaattttacagcgactgcagctcagaatgtataaaaagaaaggaattcaggaatctgagcctgaggttacctcatttttccctgagccagatgatggtaagttgtgtccatctaaaagagtaggtttttgaaagaaggaggagggtgcaaggctccagggtacaacttgctctgaatgaatgaagtgtattttggagcagatatagcttctagacatttcccatctgtattactaatacgctcccgtttgactttctcccatagttgaaagtttgatgattacccccttcttgcctgttgtagcatttggacgaccattaccaaaattaactccacagtaagtatacattttttttctccccttccaggtaacctgcacatccttttcagacttcatggaagcctagatatgaggtggaaccaggtggcttagggatagccatgggtctttgacagaaatgaggctacctgggcaactagcttttgtaataagattcccaagccaataattaggagtattgctttttgagttagaaatagatgattccatcactttaatggtacacagttgctctggctttgaggcaggaaagacactccaaactagtcagggataggagtggtaagggacatagtgacttttttgtagttgctatcatgtccacactgaatcccttctagtcttgcaagttgatttcctcatccttttttgccaggaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatcccta

SEQ ID NO: 10702 - DNA, 2614 bp, Homo sapiens
ggatatctcaggaggcttaaaggagtcctgaaatttgccagtttgtttgtttggcaagtgtattgggcagggttgaagtagaaacgattgttaacatgacagttttcaattgggaagctacaaggaaaaaatacaggaaggcagtcaaggaaaagggaaatctaaatttgagatgttatagcagaaaaaaccagttctaaagatcatagaggagaaggactgggggttttgttgcttttgtttaaggacattacttaaaacacattatttagaagtgtggctttttgaaaacagcttgtgaatgcccagaaggcccactaacactttggtggttcttccctttttccaacccctgtcagagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttggctcccttgccagtgttttgcatgagtcttgatttgggagggagggaagaggactccctaattcccccacagggtcacggtcacaactcaggtcagcccaagttgtgaaacagaagcccagagagatgaggagcccctatgaggccataaatgtgtctgcactccccatcagttatcttttttaaccacatagatcaccaggatgtcatgccatcccttagattggaagtgtcagggacagaaaagtagtgagatgctggttattcacatgagcatctagtatcctttatggcttcctttgtgtttggcaagtaagtttcccaaggtaatatgccatcagatgtcaatataactataccaagtcctgggttggggggaagtacaggtagctagctttcttgaaaagtgaagatgctgctggccaccgtggctcacgcctgtaatcccagcacttagggaggccgaggtgggcagatctcgatcagggagatcgagaccatcctggctaaacagggtgaaacactgcctct

SEQ ID NO: 10703 - DNA, 1193 bp, Homo sapiens
cagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttc

SEQ ID NO: 10704 - DNA, 1825 bp, Homo sapiens
ccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttgga

SEQ ID NO: 10705 - DNA, 1681 bp, Homo sapiens
gcaagttacctgggcttttctcttttagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaacccatagaatgcctcttttaaaacacacactacacccttttccttattctaaaatatagtcttcacttccctttcagaagcattccaatcatattgtgacagaccttacagcctctggctaaggtgataagtccaagagataggcattaagacctaattaaggccaaagactctttattgagattttatacatgaggactaagttcttcatctccaccacacttgatcagtaaatatgcatgtatcttttttttttaatgataccttcctttaacaactattttgataacctagtcaactacttgatggtatcagtaagatatattgaggcaactggctaatccatttagaaaaaaaatcagataaatctctttcacaccttacaccaaaattaagttcaaatagatgaaatatttaaatgtcaaaaactatttaaaaagtaactataaaaaaagtaatcttgagttacagagggataaactgaacaaaacccaaaagtagtgttgacaaagatatggaggaattagccc

SEQ ID NO: 10706 - DNA, 1170 bp, Homo sapiens
aaacagagaccatatctgtctcttttcacgattgtattctcagaactatcacaggagttaataaatttgaaggatggatggatgatagatggagaaaagtgggtctaatatataaaggtgattaatttctatctcccctctaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaagtaaggaaaactaaagaacattatagataaactgtaagagtggaatggccaatatacttcagggtactttgccccagaaattactgtgtcttaatagagcagtaaattatgttaaagctttgaaacactgaagcatctttcaggagatttaaaaactaaaatattcatgaaatgttatgtcaacctatgaattgtttctcctactaccctctttgatttttttgtatatggtttttttactagcaaaaacaaaattcacaatggatttggattcagatgaagatttctcagattttgatgaaaaaactgatgatgaagattttgtcccatcagatgctagtccacctaagaccaaaacttccccaaagcaagtatcttatctaatatgggttttgtcatgattgtttctaatatattgttttttgcttgacacatttagaattggttgtcaggatttttttttttaattctagacttagtaacaaagaactgaaaccacagaaaagtgtcgtgtcaggtatgtatttaagtaaaagtagtgagacatctgccttactgggacactcagatccaactgggttctaatcctggctacattatccaagtacttcctttggaaataaatttgagttcttattaacattatgttgatactgttcactgggtttagtttcacatgtaaataggtactgcattcagtatactaaaagtaatcatagtgcttgccaggtactttgctaggtgctagagatacaaaaaataaaaactgttcttgctgataaaaaattcagaaattagaacaaagttttaagagtatgttttaaatattccagaaaagtcacatatttggtgtttaaataggaattcataccag

SEQ ID NO: 10707 - DNA, 1154 bp, Homo sapiens
cagcctcccgtgttgctgggattacaggtacacgccaccatgctcagctaattttatatttttagtagagatgaggtttcaccatgttggccaggttggtcttgaactcctgacctcaggtgatctgcctccctcagcctcccaaagtgctgggattacaggcgcgagttactgcacctggcgccctcagtgtcttttctctgctcaaatgttttcctatcagaaacggcttaactttccttagcacctcttcagtcactttcccactttttcttctcttgtttatcccaccacctaacaaaatatgtgttaattgcaaacttctactggactgtgagctccttgaggattgagactttatgtccatgtgcgtgacacatagcaagtgctcaataaatattgttaaatgtatattagtcagcaagtaaaaccaagataattttcatgtataatacatgtcctttccataaaagttaagtgtgaaattcagtatttttgtaaaataacattctttgtttcttttctttagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatggtaagtattctgtgtgtgttaagagccttaacttttccttgggtttcagttgaatagattgtatgattaaagatgatgcaaacataaaatttaatttcatactttagatttattgttaaacgctgttgtgatttccgtctagtatcacatttagaaaacatactgtttttttaaatgccaatttagcttccaagttacaagaacttcaagggtactattgaagaactggctccaaatcaatatgtgattagtggtgaagtagctattcttaattctacaaccattgaaatctcagagcttcccgtcagaacatggacccaggtaaataattatggatttcttttttaggtttgtgatcaaaagaaataccttttgtactattgctgttgacta

SEQ ID NO: 10708 - DNA, 1315 bp, Homo sapiens
cagcctggacctcccaggctcaagcgatcatcccacctcagcttctggagtagctggaaatgcaggcagcaccaccatgcccagctaatttttttttttctttttaatagaggtggggatctcactatgttgcccagggtggtcttgaactcctgggctcaagtgatccacccacctcggcctgtgtcctttaatgaccattcccttatgcctatcagtgaacatcattgcattggttttggaaagtcctcatagtctatcattgaacctattttttaataactttcttaatactgttacctttaattcctgtacaggtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaaggtaattttattcttaaattattaatcatgatttatctttacatatatgtgttcttattgtttttaatatataaagtggacttgaatattgggctagcttagtataaaggaggttaaattagtttttaatgtttgattattataattttgaggatactgagttttacagtttggtatttttccttattagggtggcagacatgttgattatgtagctgatcagattgtgactaaacttgttgatgttgtgaagaagaagaacaagggtggtgttgcagtaaaagcacatcaggtatgtgcttttggcagttttctttttctaaagtcaaggaagaagagaaaggctataaataaagcatgagtacatttttagtggcttaatatcaacttctattgcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgtgagtacttagaggaaaataaaaatagaaacacctgactttattttccattgcacttcttagctctgcagaaacaatgattcttctcatagtgagcttctccaagtcttcccaatctgaaaaggaagtaaaaaagggctttactttaactgatttaccaaagacttaatgaccgtctatatttcagtatttcccaattacattttaccattaagcttagatcacttttgaattaatctagctgtttaacaaacaccctcacttaaatgcctaagacttgctttcagt

SEQ ID NO: 10709 - DNA, 1208 bp, Homo sapiens
tttctttccattgggcataaatcatttccctctgtttatcctaacattttaaaattttgtattttttcaacattatcagtgtctattcaggtgttggaaaaggtttttttttcctcttgactcctatttcaggaatgtcaggaactaagcatggtgggaaatgttcctgctgaatttcagaaggtatatatgaaaagtgccaaaaaaattgagggctgggtatggtggctcacatctataaccccaacactttgagcagttctcctgcttcagcctcccaagtagctggaatcacaggcatgcgctaccatgcctggctaattttttttatttttagtagagacggtttcaacatgttggccagaactcctggcctcaagtgatctgccctcctcagcctcccaaagtgctgggattacaggcacaggccaccgcgcccagcctgaatatacatattttagaaataatagtatttaaatatttttaaatgttaagcattcgtttaatgtgttgtaaaatacaattttcaatctttttttcttagggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtagagtattgaggggaaataacatatttgttgctaaaaatatatatatttaaatgactgtctgtggcatgagggttaaagatatggaaataaatctctataattgaatagctctgccagtgattaagaaataaagctgtcaatgagatagtaacaataaaatagtgtttcatatttatttgcccaggtggtcgaaatggctatggagccaaattgtgtaacatattcagtaccaaatttactgtggaaacagccagtagagaatacaagaaaatgttcaaacaggcaagtaaataagtgtcttgtaccttaatgataaatggtagtagtatagccatttataatggcattaatgattggtttaatttaacataatttataagctattgaagtatggaaaattataagcatatatattaggttattaggactcataaatttatgttatttacttccagtttgtgagatgacttgaatttttcatgtttcctattctttacttccatagacatggatgg

SEQ ID NO: 10710 - DNA, 2463 bp, Homo sapiens
cggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatggagaagtaattcagctacagggtgaccaacgcaagaacatatgccagttcctcgtagaggtgagttcagtcactacttgatttgtgcctctctgctggcaaatctcagatcctgtctgttagcttctgctggggacataaaagttggctttgtaaggctgagcaaaacctcagttgggttttaaagtacatagacttatttctgttttataggaaaaagcagaagggacttgtctacctttggtttactgtttctgtggatctacttcacagatgcaaatttgaatagcatatagatgcattgtaaaataagccaaatgctgggttgttcctgtatttgtaaggacatgagtttttaaaaatgaatttcctgagtattaatactaaaatactgttacatgatcagctcttgatataattgaagagatttcagatacctgatgagtctcattctcacactaattcagaaccttggaaggcactgagtgttcaaaaaaggtagctcttaactgaggaccctctgttgaaccattgtgcgcacccctggctcttgggcagtgtagtagcaggaagacagggttgttgccattagaaatggaggctttaactctccctgtcccccatttaaaactttgcccttttgtcttttcagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaatacctgacttgcagattatttatatatagtcgatcttgtgcatataaaggaaccatagaaatgggcagtggaggattcgtccacacccacagcttctcaacgggcctgaatttggccaagaaaaacctttatgagcttgtccctctctggtcaactggttttttgttcgtttgttttttgagacaggtttgcccttgttgcccaggctggagtgcagtggcacaatctcggctcactgcaacctccacctcaggttcaagcaattgtcgtgcctcagcctccctagtagctgggattacaggcaccatgcccagctaacttttgtatttttagtagagacagggtttctccatgttggccaggctggtcttgaacacctggcctcaagtgatctgcctgtcttggcctcccaaagtgctgggattacaggcatgagccaccatgcccagcaggtcaactgtttttgcaag

SEQ ID NO: 10711 - DNA, 1746 bp, Homo sapiens
acacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctggcccagcctccagctgtctctctagggagtgtgtgtgtgcacttggcagggcgaagttgtagagaaagggtggatgctaatattgaagtatgtgccgaggactcctattaaatacgccgtttaatcatagcagcagctcctagagggcggtgggtgatgtcataagtgtctgttggatggagaaactcaggccagagtaggttaagtgatgccctcaccagcagatcatggctagtgtggagctgggatttgagctcatgcttccctgatcctttcaccccagagactgactcagtggcctggctgtgaaagataggatgggagagagtcacccactgtcttagggtgaagtccccagagcagacctggaacagggtttaggaacaagtatagtcgccctccgtatcctcaggctctgcatccgtggagtcaactaaccacagatagaaaatatttgggggaggctgggtgcagtggctcatgcctgtaatc

SEQ ID NO: 10712 - DNA, 1116 bp, Homo sapiens
gaaggctgtgcagactgctccctgcagggtagcttgcagaccctaggaccgagccccactttttgtccccagacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctc

SEQ ID NO: 10713 - DNA, 1207 bp, Homo sapiens
gcctgcctgtatagtgggaggattgctaccgttggggatgatgagggtgtaattagactcctgagatttcagggttgaaaacagacctgatgggtaagggaggagaatagagtaggggtttgggcccctgagtcaggctgccttataacccctctgtgcccagttttcccatctgtaaagtggagccagtgatagtacttaccttgcagggtcgttgtcaggttatgtgagaaaatataagcagggcattgaattcactgccaggcacataataagtgtgcaaaaaaaaaaaaaaattcccttgatggacagaacatgtggggcctattttacagagattactgaggtgatggtgacttccccaaggttcctggtgagaggtagaatggccagtcatgtgctgggggtttgggcagggcaagaggtagcccagaggacccaggtggggctgtctgtggcctgccctgctccccagtgtctgcccagcccactgcctgcactcagtccctgtccccatggcccccaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtctgtgagggtccctgctagggtgggggctgggcagggaggggagagagcagatgtcctcaggggagggacattgtaggggtggagggaggttatgacccagactctcccgtgtgtgatgagtctgactggggccctcctcagctctgtggaagggtatcccggcctctccttagtgctcacgtccccgcccctgcctttgccctccaggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtg

SEQ ID NO: 10714 - DNA, 1918 bp, Homo sapiens
ccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgttttttgttttttgttctcagagttgtcttctgagataattattaccaagtcatttgtggggttgtgtttttttcacatcatgtgacagaaattataactcataagatttaggcataatctggttttaaaaccttgattgaaactgttgttttttaacttagcaggcagcctaggccatggctgaaaagaaggggtaagtccttcattgcatgatgatgtgtgcaggttttcctgattttctaatttttatttttgaattcacatgtgtaatttcacatcaataacttgtgtttctgaaatatcctaactaacttgttaataaggaaagaaaccagatttgcttaaatctgttcaaggctgacattctgaaattctaaactggaaataacttcccagagtatttggaaaggttctaagtacaaggatcaggcctaaaatagctccttgggaaagaaatttcctttttgatgagaaaacttaaaatattgtttttggtaatgtaagcagttaaaaacatgactttagaaagacagcttaatgcgtattcaagcaaacctttgttttgttgcttttgcttttgtttgtagaagagagaggaagttattataccaaaaagtaatagtatatgtaactttgagtgaggctacttatatcttagaatgggtatccttgaactatatctaccccaccatggcttaaaaaaatcagtggtatatattgagaatgtcagtcatgagcttagtgtttaagtaacacatcccacttacagttgtttgcatgattagtcttgtgtatcatgatgttcaactttgcttttgctgtgccagttcaaaaatatcttttttgctaaaaactcttaaaattcatgacataagttttgttttgatcacccggttttatatagtatttctgggaccaaaaaatttaaatatacctttttaatataaaacagaagtttgaagctggaaagatagtgtttatggaagatttgtgtgcttttgtgttttttaaacccgtcaggctgctggtaaggcagtttctagggctcacttttcctccttacctcttgactagtgtagcatgtggtatgtttaaaatatttcattttctgctttgtaattctaaagtcaacactatactgtatgtagacaggagagctgatttgtatattttagttatttggtctaatcaagcataactaaagggacttcttttttgatacttttctcaaattaagtttaaatatagtatacgggccacatttcatgtctttgaaagtgttgtacattactgtaaaccaagtactctgtctacaccagagggtgctttaactgcaaaatatttgagaaacaattcagtctctcaaacattttggcacagttcatcactccagtttgttactttcttgagaatagtccattttttgtttttgttattgtaccgtatgttctggtcattggaaacagaacagctcatagttgggtgatgtaatataataacagtaatataacctagtagtcattttgcttcaagtaatttaattagatagcaaaatcactgcggtttgtttattacacttgtagggctttttatcttactcagtgaccatcactacgaatgtcttacattgaagcacagactgcagagcacttgttaacttagtcctc

SEQ ID NO: 10715 - DNA, 2309 bp, Homo sapiens
cgacagtggcaagatgtggaatctttgccgcttattgacaattactgctttttccaaatgtctgtggtcaattcaaacttttatcagacagcatcatgttgtcccaagagttattgtttagaaaacgaagaggcagtaagaaaaattgccagccaagtgtctgatgagatccttgaaagcttgcctccagaagtcctaagcatcgaaggagcagccatttgctattacaaagatgatgtcttcattataggaggctggaaaaacagtgatgatattgataaacagtatcggaaagaagcctaccgatattgtgcggagaggaagaggtggatgcttcttcctcctatgccacaacctcgttgtagagccactgcttgtcacgtgaggatcccataccggtacttgcatggcacacagagataccctatgcctcaaaacctgatgtggcagaaggaccgcatcagacagatgcaagagatacatcgtcacgccctgaacatgaggcgagtgccaagctctcagattgaatgctaggttctctcaagcgtgccgattaaaactgttacacccgtttcgtgaagctgaagatacccaggctgttatttaaaaaagtatgtcgataacttattttctacatgaactgattattaccccatataaaggaaatagagttaaaaactaaagaatgggagactcagttcaatacatggtcattttgttagcttgcaatttttgtctttggtttgtttgtttgtgctagctaaataagatcttattaaggacaagtggaaaaatcaggtgtagttgcttagctgttttcctgccaacgagttatgactcctttgtcttgaggacttacgttttgaacatgctttaagcaccaattttatttgcacatttactttgatattctttttcattttttattaaatgattggttttggcaagatctgacttctgcattgagccctcatctgcaggaggcatgtgcaatagtgagactgaaatttgaatgaaaacactcaatatttcagcaagataatttgagaatgtttgcattgatattttcttatgtttatctagaaatgccagtttccttcctagaagatgtgactgatgagaaattttttactggctcatgcattttttgaatatttttcattagcagctgtttatagactttaagccttcaatctgaggtgacggtagttggcaaaagtatagatctttagctaattgactaaatacagagcaagttacatgtgtgaactttgtttctctaagaagaaaagtattagtgtagactgggaaatcaaaggcatttaaaattttttcaacatttttttcaggagttgcaggattatttgaggatatgttaatgagtgtaaataatgcctatgacaatcgacactcaatgccttccattttaatttttgctctaatgcatattatatagaatcttcattattccttttctctttttttttttttttttgctcatgttgcccaggctggagtgcagtggtgcaatctcggctcactgcaacctctgcctgccaggttcgagtgattctcttgcctcagcatcccgagtagctgggattacaggtacccaccatcacgcctggctaatttttgtgcttttagtagagacagggtttcaccatgttgaccaggctggtcttgaactcctgacctcaggtgatacgcccgcctcagcctcccaaagtgctgggattacaggcatgagccaccgtgcccagtccattattcttttctacaagaaactgtttttttccaaaatgggaaggaagtcacaatttagagaaatgttgctaaagagaagccttattatttctgattgttatattttatccagttgccccacactttcaaactttgcctgagcctaggataccaaatttgggtacataattttggcttttaaaggtttatgggctgggcacggtggctcatgactgtaatcccaacactttggaggaggctgaggtgggcagattttgagcccaagagttcaagaccagcctgggaaacatagcaagatcctgtctctacaaaaagtagaaaaattagctgagtgtggtagctggcacgtgcctgtagtccttcctacttgaagccaaggtgggaggatcaccagagcctgggaaggttgaggctgaaatgagctgtgatcatgccactctaccttgggtgacagagagacggtgtctcaaataaaaattaaaaagatcactgaagctatcttttatttagttttatacgttattcgaattatcttatgtctc

SEQ ID NO: 10716 - DNA, 1646 bp, Homo sapiens
aagtccgcctcatctacctatacagtggatttggactaaacttcccactgctttgtgtctactttttttgtgtgttagaaagatttcccttccttagcctcttcctctcaccaggcttatgaagctctaataaaaaagatgtgtttgcttcattttaggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggctcctggcatccatatcctttgatctgtattcctttgtaactgtacttttttccagacagggtatcactctgtcgccccagggctggagtacagtggcaccatcacagctcactgcagcctccatctcctgggctcaagcagtcctcccactccagcctcccaagtagctgggactacaggagcatgccaccactccaggctaacttttgtattttttgtggagataaggttctgctgtatttcccaggctcttctggaactcatggactcaagcaatccatcctccttggcctcccaaagtgctgttacaggcgtgagccactgtgcctggcctggcctgaactgtactaatagtttcagtatatatggttttaaaaatgctcatctacggtcaggcgtggtggctcatgcctgtaatcccagcactttgggaggctgaggcgggtggatcacgaggtcagcagatcgagaccatcctggctaacacggtg

SEQ ID NO: 10717 - DNA, 1417 bp, Homo sapiens
gcgcggtggctcatgcctgtatgtaatcccagcactttgggaggccgaggtgggcagatcacttgaggccaggagttcgagatagcctggccaacatagcaaaatctcgtctctactaaaaatacaaaaattagcctggcgtggtggtgcgtacctgtagtcccagctacttgggaggttgaggcaggcaaattgcttgaacctaggaggtggaggttgcagtgagccaagatcacactactgcattccagcctaggcgacagaatgagactctgtctaaagaaaagaatcaggaggttttgccttagagttgtgtggtagtattagacttggattggtagttacccttcttggatttgaatgacttgtttagggagatgggggaaagtacgagcatggccttgtcgaccatctcctggcctttgttccccccactccaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcgtaagtactgtcatcatgggaggtgaacagtggggacactgggccttggcctcatgctgctttgccacagcagggccctagaaggagcccctgagtgtaaaacccagtgctcagggccgttcgggacacactgggttggtttgcccagctgaaggaaactcttaaagctcaaggcaacacgcacttgtttctcctccagggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcggtgagttgttactctcctaaaaaagtgggatggaggccaggcgcggtggcccatgcctgtaatcacagcactttgggaggccaaggcaggtggatcacttgaggtcgggagttggagaccagcctgaccaacatggagaaaccccgtctctactaaaaatacaaaaaaattagccaggcgtggtggtgcatgcctgtaatcccagctactcaggaggctgaggtaggagaattgcttgaacccgggaagtggaggttgtggtgagccgagattgtgccatggcactccagtctgggcaacaagagtgaaactccatctcaaaaaaaaaaaaaaaaaagtgggatggatctactgggtgggtggtgatagtgggggcattaatttatttgggagaatacctaagctttcaactccaacatacaaagctttggatgtgttgacagatgccaaatacaaagcagctattttttccatgttataata

SEQ ID NO: 10718 - DNA, 1168 bp, Homo sapiens
ttgggtttgtccaccgtaacctgaggaaagaagtcaagctgatgaggacagtcagagggaccagggtccctgaagctgcactgaggatctgagggtgctgcggactcgggagtccagaggggaaggaaagggcttggtctacagcagagaggagttaggactggtaacaaaggggacttccaagtgcagggatgagaacgacctgcaggcaggccccacccctcagctggggttggtcatactgattcagtctggaccaccagccagtggggtagaggcttcttcctcttgtcctcggggaaaagatggtggacaagtctctggatgaatggttttcactgggttttagaaaatgagaccgtggggattggtttcctctcccagtacatggtagaccatcttccccagttcagcgcccctcaccagcttcgcccccacaaccccaatcccactgtcctgtctcttcacctgcaaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagagttgagtgagagggacggtagggaggtggcagttcggatgagaagaccgacaggctctgggcacagactggggagagcagagcggtctcctctctgggagccaggtggtagacacggccctgtcctgaggaagacagctgggtgcagggcggggactggcttggaaccagactgaaatatgccgccagcatccctcacctccttgcccctgtctgtctgacacctctgcctccagcttctcgcctgacagctcctttccgcctcagtggctgaagagctatgtccagggagcaggggttgcagaggagatggaagggccagtggggtgcgtttagggaaatggagctgtcggtggcagtgagagattgctgcggggcgcctggggtgctgccgagctgctccctgatggatgaactgtccctctctccctcccacctctagaattctggccagttttatctccggcctcttcaatttctacgaggacttgtacttcacctac

SEQ ID NO: 10719 - DNA, 1806 bp, Homo sapiens
aaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctagctgtgtgcagtctctcttacccttctgtgcccagctcagtcttccctagggctgggtgtattaggactggctttgtcccacagcttggggccatcggtcctgtctcccctctgctggccgggcacagctgtggtgaggttgggcagctgaacagtgttggctttcatgaggaggcagaaagcagaggctggcctcagactcatacagaaggtgggggttggctgggtacgagggatgtggagcacaaaagcctctcatcccccattaaccagggcaccaagcccacaggtgtccccagcccactggatcagaaagagttcagtaagaccggaagctcctggtatgggtttctcccagttctctagggaaggccacctgcaggtcactgaaacttcaagcaccagggaagatctaacatttgagtcccttccaggccatcagaggcctagtcagccacatgggaaacttccaagacctgactcaggcatcattccaccatggctaaggcaccagccgggg

SEQ ID NO: 10720 - DNA, 1622 bp, Homo sapiens
ttttcttttttttttttttaagatggagtcctgctctgtcacccaggctggagtgcaatggcatgatcatagctcactacaacctttgcctcccaggttcaaacaattatcctgcctcagcctcccgaataactgggattacaggcacatggtaccacgcctggctaattttttgtatttttagtagggatggggtttcaccatgttggacaggctagtcccgaactcctgacctcgggtgatccattctgtcaagcttgattcctcccatcttgggccaagggcccctcctttctttcgtgctaccgaaatagaagcaaacctgtgtttagagttcccttttctgtctcatttacctgcatctctcattgatgcaggcctcccaaagtgctgcgattacaggcatgagtcaccgtgcctggccgagtagattttttttctaatctccagaagaaagcaccgtaaaagtccctggcatggttaacaaggcctctaactcccaggcagctgggctgagacctggtgaggaaaaaaccagagtcagatttgtccactgatgccagatgtcttcctgtagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccaggtagagtaggtgcggggagtgggctcagtgggaagaacccgcagggcaggccaactgccacactcagtccagaggggaccccttggagaggtccttcagctgagaataaggtgttgcagacttgtggaccctccaaattttgggaagtgccaaattccaaaattagacagaaagtagtttttctcttaaactttgttttcttgaaactttgatttccactgagttgttcttttactccccactttagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtggtgagttggctggggcagcctgggatgaatttgacagctgtagaatgttagaattttttccaaagatgctccagagggagagtctatttgggccaaatctgatccctggtccaaacagtaatagacatggagtcaaacaaatgcagtcaaatgtggcaggttcacagtgtgcagtgagctctgaggaggcgagcactagcaagggaaggcttggaagtgcagaaaagcatggccccatgggtcatgcctgtaatcccagcactttgggaggccaaggcaagcagatcacttgaggtcaggagtttgagaccagcctggccaacatggtgaaaccctgtctctactaaaaatacaaaaattaggctgggcgcggtggctcatgcctgtaatctcaccactttgtgaggtcaaagcaggttgatcaccaggtcaggagtttgagaccagcctggccaacatggtgaaacctcgtctctactaaaatacagaaattagcca

SEQ ID NO: 10721 - DNA, 1712 bp, Homo sapiens
cccatgtccattcctggttctatggtacattcacaggcctatgctctgtccctcttccccaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacct

SEQ ID NO: 10722 - DNA, 1865 bp, Homo sapiens
gttggagttggaggcctctcccgctggtttcttccctgggggcaccattcttgctctctcagcaaggaacccccaacccccacctgaatgctcttgcccccctgcctcccccacacacaggcacctcccttgacaaggagagttgatggggaggcaggctgggggcagcccgccaggctaacagggcccatccatctaagcctggagagtttattcctgctctgccggtgggagactggagatgaaagagacaggcagaggtgttaggggtctgtcatggtaggggtggtttagggtggagtggtaggcttcatgctgcccacagagtcctcccagctgaggggtggagggactcactggggcaggggctctgggcagtgggtggagtcatgcaaagggccctagagcattatccaaagcaggggaggtatggggaccccagccccctcccagggtctctttccacccaggacaaggcactaattcgctttgactgatgaagcatctcagaactggaaaggctggcatcacctaggcaactgtattttataaaggggaaactgagtctggagacaggtagtggttctcagggcccatgaggagttcatagtgaaccaggactaaaactcagaactctcaactcctagcccaaaagatgactgtgcccttcagcccacagtcatctatttcatcagaaggaaatcaggccaggcatggtggctcactcctataatcccagcactttgggaggtggctcacttaagcccaggagttcaagaccagcctgggcaacatggcaaaaccccatctctaaaaaaaaaaaaaaaaaaaaaaattagccaggcatggtggtgcatgtctagtcccagctactggggaggttgaggcaggattgcttgagcctgggaggcaaaggttgcagtgagccatgatggcgccactgcattccagactgggtaatagagctagaccctgtctcaaaaaaaaaaaaaaaaaaaaaaaagacggccgggtggggtggctcatgcctgtaatcccagcactttgggaggccgaggcaggcaggtcacctgaggtcaggagtccgagaccagcctgaccaacatggagaaaccccatctctactaaaggtaacaaaattagttggcatggtggcacatgcctgtaatcccagctactcgggaggctgaggcaggagaatcgcttgaacccgggaggcggaggttgcagtgagccgagatcacgctattgcactccaacctgggcaacaagagcaaaactctgtctcaaaaaaaaaaaaaagaaagaaaagaaatcagcagaaagctgattctttccaagacacaggaagatttgctttctctaaagctccattccttatacacacaggtgaacacacactcacactcatacccattggtactgtggttctgggatgggtagcccagacctggggcctcagactgaaggcagctagccagttgcctctacctccctcactctgccacctccccaggcacgaggccaggatgagcagttcaggactgaaaagccatgtccagccattggccaaaacctgccaactctacctttttttttttttttttgagacagaggctcactctgtggcccaggctggagtgcagtggcgcaatcttggctcactgcaagctctgcctcccgggttcacaccattctcctgcctcagcctcccaagtagctgggactacaggcacccgccatcacgcccggctaattttttgtatttttagtggagacggggtttcaccgtgttagccacgatggtctcgatctcctgaccttgtgatccgtccgcctcggcctcccaaagtgctgggattaca

SEQ ID NO: 10723 - DNA, 1206 bp, Homo sapiens
gctcttgccccagaggtataggtcattgactgatccttccacctccaggccaatgaaacctgtaagtgtaatggctggaaaaaccccaagccccccactgcaccccgcatggatctgcagcagccagctgccaacctgagtgagctgtgccgcagttgtgagcaccccttgggtaaggcaggcagcgcccttggagctgggggcaggtgctgggtcctgcttggacagggtgacaagtgccacaaagcttcatctctgaaaaaatcaaagatgcctcgaaggagggattgggttgggggggggtgtgcaccaaggggggagaaaggaaatctctcagcccagaacaggcccaggcaacccaacggttgatatcggagcagtcagtctcactgttggtcacactggttggaggaacagagtgtgtatcttgcttggctgtgaagagggtcaagaagccttgttgatttcttctatcaatttttcctaactctgccatctgtcttgcagctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaaggtgagcttccactaaaggagggtgtgagtgaaggaggtggggccttgaggggttgtctgcagctctgcccccctcccctctatgcccccttcctcttctctctagctactgcggaaatgcatcctgcagatgacccggcctgtggtggaggggtccctgggcagccctccatttgagaaacctaatattgagcaggtgagataggggaattggagatagcggataggagaattggggacagcttggaggagtggggagcctgtgttctccattctcctcaagctgagaacactggggaggttcagagaaggaagggtgttttgtgctaacctcagggtgggcatggtggtagggagggggcagagcttttctatagagagcacccgagagagagaggagaaggagaaccttgtccctggccagggagcatcttcctttgtctaagaaggccctgcgggctgctcacacctcattcctggttttatcccccacccaccccttctcagggtgtgctgaactttgtgcagtacaagtttagtcacctggctccccg

SEQ ID NO: 10724 - DNA, 1758 bp, Homo sapiens
acatttcactctctgagcctgtagcctgccacccatttcagagcctgccatcactacccctacccactgcctaggagtttttagctcatttggctctggaatcttccttcctgggttgcagatcctggctctaccactcattagctctgtagtcttgggcaagttatttaaccttactttgccgcagtttcctgaaaacaatcagaatgcacctgacacacagaagccctcaatatgtgagttaccactgattgggtataaaggccagaatctgctccagtggaactgggagagttattggggtacccccaacaaatgcacttttccccctcccaaacagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaattgtcttccttgtctttctctggcagtttatcagacagtgccctctgtagttgaagttgatttaaaatgaaccactgaatcttgttaaacaaaatcttcccctctaatgtgaggggatgctggtggtcatggtaaccaagagaaagaggctcttactgttagcagctccgatgaggtagctgacctgggctgaccaagtttgaagtttcagggcccgtgttcacttctccacctcccttcccctcccccacctaccagatcatactggggtgacatgcagtgtgtatttgatgatcattagtctctgaaacaccagaaacaacctctttgggttttttttggttggtctttaccagtgagagggtctggatcctctctcttcctgaagaggaaggaatcccaacagcccctggaacgctggactggtcttaaggccaagactgtagccactggctttcctcaccacctctgtccacgtcacccccccacaccaca

SEQ ID NO: 10725 - DNA, 1311 bp, Homo sapiens
aaggacacagcgggtgacggcctctgaactaactcagtacttctcatttctcccttacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggaggtgagtgggcatgagggagtcggggaggggcctgaaggttgccaaagaaatgctttgaccttgaggagatgggaagctgcctgcctgcattagggactaaatgcgtctgtggtggcagccccacttcctcacctgggccctggaattgagcccagcaactggtctccatgccagagtcccctcaagcatcgctagtaagcatttgctgggagtggaaagctagcttcccatcctgtttctgccccttcttgatctgtgtggccttggctgaggccctttcactgccctggcctcatggagggagagctgactctggatctttgaggccccttcttactataatgggtggtccatgtgccctggcctttcccacttccagaagaaggaacagcctggtgagtcggagctgggtgataggtgggtgtttctgaagctgactttaccctttctggagctcacagcctgttgttgattttccagtggtcagcatttaggatgtgagtgagggtctggcctcggcctcttgcctccgtggctaacacacacatcaagaggcaggggccaacgctggccttggccttgagtcatcctttctctactctcttggtaggaggtttctaggcagctggaaacaaaatgggccatgtcagcagtctccctgctgcctcctcagcatttgggtcaggagctggagaggggaagtgaggcagtgccccatgtccctcagtgagctgggggagggcagaccaggaaagcagccttctacacatggctgtcctgggttctctgctgggtccaggggcaaaggggccttttgctgtctgtcccagctctggactcctcctttgaagcatgtgtacaggcaccctgcattcccctaaggagtcacctcttagtgactgaaggtcaggtcacagggtggccatacaggaacaggtctgggtcagagctaggggcggtggctagctggagtgcctggaggtggtaggggtggttg

SEQ ID NO: 10726 - DNA, 1291 bp, Homo sapiens
ggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaattt

SEQ ID NO: 10727 - DNA, 1132 bp, Homo sapiens
aaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccc

SEQ ID NO: 10728 - DNA, 1147 bp, Homo sapiens
cctgtccacagagaccccgcaaacaagcgcatcagaggatctgggtggtgcgagagcctcctacagcagccaggtacacacaaggcctcagtttttccatctgtgaaatgggtacgtggacagacctgtccagtagcctcccatgtgagaatcctcggactgagagggtactaggagggctaatacagcgcagccctgtgattccccacctctgtccctggaatgaaggaaatctgggtgttagttctggctttgccgatgcctcttgggtggcctggctgaaactaatctctcctcatcaggccagaagggaatctgtgaaatgggctttgaaacctgccttgcctttctccgcccggtcccagcgggggtccgatcggcatcaaggcttcacccactcccagagccttcgggatcagccccaccccatcagcaggacacagcccatgccactggaaatctcgcgagaatcccgcgctgaagcgaagtcgagacgtttgaccttcctccgtttccgtagttccgagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggc

SEQ ID NO: 10729 - DNA, 1167 bp, Homo sapiens
ttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgaggg

SEQ ID NO: 10730 - DNA, 1611 bp, Homo sapiens
caagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgct

SEQ ID NO: 10731 - DNA, 1275 bp, Homo sapiens
ctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaaactgcccaggggtgcactgttgggtttttctttaaaatagagtactttgtattctgggagaatcaagttctaatgaatgcaggtatgtggaaattctgttgaaacttctttagagttagttttagttttaaaaaaagactctagtaaaaatagatagctgttgaggaagccttgtttgtgtagatctgaataatggaacagagatgttaaactaattttaaggggaaataaaggctacctccttgatgcttagtcaaggtcacccagatagtctgtatttgagcccctgattaatactgattgcaatgcctgatgttcctcttaatgaaattaagctaaaagtataaataccttgttaaacaaaaatgaaacaactaatctgtctccacctagctttttaacattttcaggctgatatgacaaaaagggcatgctcgtccaccttaactctctctgataaaggaaaaataagcatgaaattggcatacaaaatacagttcaaaagagacttggaatttttgtacccttagtatgaaagtaaacagagggaggcatgagtgc

SEQ ID NO: 10732 - DNA, 2469 bp, Homo sapiens
gacatcgaacaaaatgatgttatttgaaaccaggttatttgaggaccttctgtacttgatttgcttacctgctgtactttaatttccttcaagtcgcagttgctaagaacctattgatgacattaaggacttaccgtatgcagatgattgcttggggatttgtgaaggggtctctcattttcttgatgaggtaagggttgtacagatatgtgattcccctgatccctcttctctcaggtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctg

SEQ ID NO: 10733 - DNA, 1842 bp, Homo sapiens
aaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaggtctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctgggtcctgcttgttgcctctgagagtggagggaaggtgagctcctggaaggctagtgctgccagcagaagatctgggctgcttcctgccccctgcctctttccatgcccaaatcacgtttcctttcatgagtgaaatgaggaagaacatcatggcatgcaggctctttttactgttctgggcagtgttttgcaatgtgtgacccctccgcactgttggtgaacatacagacctcctatatgggcacccaagcccaggccagtgtgagaaccttggcgggggggtggggaggatgagaaggggaggcccctagcctgactcagaggtgaagactgctaggccctgctgtcc

SEQ ID NO: 10734 - DNA, 1205 bp, Homo sapiens
ctccccgctgcttctctctcaccccatcctgctctcaaaccaagcctagcattctcacctccttcctcatgtgggagagtcctgagggatacatggtttctgcgtgcttgaggaagagagggcacactgctggcatggcacaaaggctcacgctgtgcctccctccacccctccacaattctcttttcttctcctacatagtggcaaggagagactcaagagttctgccccaatgccaaggttgtgctggttggctgtaaactggacatgcggactgacctggccacactgagggagctgtccaagcagaggcttatccctgttacacatgagcaggtgggacccttgacgtctgacctcatcccagcctagacctgtcacctctgccccttcagtctctgatttgaaaacaccttacctggctcatcctttgttctggtctgtgacctctgacctgatcccttgactgcccccagccttgacattcaaccccagcccacagcctccatgcccctttctaagctgcaggctaagacctataactttctcccatgcactccttccttttccagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctc

SEQ ID NO: 10735 - DNA, 1759 bp, Homo sapiens
agagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaccatgaatgactgttcttgagacttaggccagccgactttctcagagccttttcactgtgcttcagtctcccactctgtaaaatgggggtaatgatagtatctacctcctaggatttattgaggcagcttaaataccttttgtatttcctgttgctgccaaaacaaattgttgcaaggtcagaagtctgaggtggctcaactgtttctttgtttcaggtttcatgaggccaaaataaaggtgttcgcagggcgtgttcccttctagaggctctgggtccttgcagttctaggactaagatccctgtttcccactggctgttggctgggcatcattctcagcttcttgaggctccccacattcctaggctcctggcctgtctgcctccatcttcaaa

SEQ ID NO: 10736 - DNA, 1173 bp, Homo sapiens
agcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattct

SEQ ID NO: 10737 - DNA, 1231 bp, Homo sapiens
taattactcttaccatgacttttttagctcaggagtgagacctatcctctgttttgttttattgttttaagtttgtcagaaaatttattgtttctaatatgtggtcctatactagtaatatcagtattatttttaaggcaaatgggttagcacattttcaagagtcacagtcagactctcaagctagtgtgaggtattcagaagccttcacacccaacagcaagtgactaagcatctgaatttctgttcaggctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaaggtaatttttcccacaaaatgcaaagatgaggtgatttgaagtggcagagtgctcagctgacaagcttgctttctcttcttactgttcttttcagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggtgagcattgactgacaggctttggcctagtatccaaatcttagttagagaggagatggctaaaactaaaagaacccactcatagctggttgttttccagaaaccttgaaaggttagcatctccccccgccccaacacatctctatgctgatatttggcctcttccttagggtgtttgttttagcgtctttagggtcttgctgcatactgaatacttttgtacctctttgtgatgttgcatggtcagcctgttggctgcacaagggaaaaagggactcctggcctgggctggcctgtggaactgctgaactgatagctttactccttaacatccatctctcctgaaataccctgtgtatgttccctaaatactaatgaagtcttgccctggttgctacttagtgaacagttttttaatgcaatttctctgtatta

SEQ ID NO: 10738 - DNA, 2256 bp, Homo sapiens
cggtttcccttttctcctccttcaagtacacagataactaatctaaaatagggccttcccagtccgaaccgttggtatcaagtacacaggagtgccatagccttgaatctaattacctagtactttgaataaatctggaaagactagtatgcttgcaagatgatacaaatgtataaaataaacatttaaattatacagaatttttttttttttttttgctttgcttgtctctacacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctacccggactggctagtccttgcggaagcagcgtccgggccctcgggtaacgtttgaagagctggcagcgtctcaggctgctgcgtggcgaaggggcggaccgggggacgggggggtgggcccttaggggctggggcgggacttccctgggcactgagtcaaagcttgaggggagtgttcgctcccgcattttcgattccactctcttccgtttctgtcgctgcagtcgtcc

SEQ ID NO: 10739 - DNA, 2256 bp, Homo sapiens; identical to SEQ ID NO: 10738

SEQ ID NO: 10740 - DNA, 1177 bp, Homo sapiens
tctcctcccccaaaaaagtgcaacactgtaactgagaagcccaagcatggagaagttgagatgaaaaaggagtaagaactgtgaagggagagtcagcttctcaggaaccagcatgggagagaaatgccccgagcatctgcctgtactggtagaagggccacattccccactcccccaccttaccccatacaaaggctgggcggctagccaggctgaccagaccttctctctccccataggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccattagttctcctgtgtcctctttgctgccatgtgggaacag

SEQ ID NO: 10741 - DNA, 1190 bp, Homo sapiens
caaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaagtaaacactttttgagcaccaaatatatatagggcattgttctggtgggtgtgtcacgctcccagaagactgaattcatggtaggatcactcgcaaggccttgtgaaggagtcttacctaaaacgaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgggaaggtctctgatcacacagaagcagccct

SEQ ID NO: 10742 - DNA, 2158 bp, Homo sapiens
ggatggggctgtggaaacctgggttggattgtttgggagacctttcttccgcatctcctttgttgacctgggttgcctggtctttttcaggttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatcactcatgtctcaggtttgtgcgtccttcagaggccccaggggagaggatccaaggtatgtctgtctgatttgacctttctctttagagtctcttcttcctactatttaccctctcttttcacccccgaggactcatccagaaatataatgcagggtataatttaagatgggggtccagggtttggagtggtgtgtaggtggagtgtggggaaaaggctgtagtcacatacatagaaccatttgttacaggactgtttggaggcacaaatggtcggcgagctgagaagtaaactttcagatccacctgccactggtctgaacttgatttaaagaactgagcctttgatttagcctacatgggaatgtagacttagagaaggtgagagagggagaagggaagaga

SEQ ID NO: 10743 - DNA, 1231 bp, Homo sapiens
aacagaatatggatgccctgtggccaagggtggagtcctgggctcaagcgatcctcccagccctcagcctcccaaaatgctaggattacaggcatgagctacagtgctcagctgacaggtggaatttgaccattgggtcagagcgcgggccattttcccgatgcttctacctcccctcataggacattcaccatggcaatggcacccagcaggcgttctacaatgacccctctgtgctctacatctctctgcatcgctatgacaacgggaacttctttccaggctctggggctcctgaagaggtacagctcctgggcgtaaatgcagaccctcctggcccctctgggaggtggcacaatgggacctggcggggagccacggaggcccatggtggtgttggtacctggggagtctgggctcctagtgggaggaccacactgatctgactgcccctccaggcagagcagaggtcagtggagtgagatctggaggcaggggtgagggcaggggcaatgtttgggactcccaggtggtgagaatagccctctccccaactctggtgccaggttggtggaggaccaggcgtggggtacaatgtgaacgtggcatggacaggaggtgtggacccccccattggagacgtggagtaccttacagccttcaggtagggactgaaaagggccatggtagtcagtgggagcccctctgggccctgcagtgggaggggcagaaggcactcagttcagtgtgggtagagggggttgtctctgggaggataacagtggggcgaggcctggcctggtcatctgccgggctcagcttgagccatccctttgcaggacagtggtgatgcccattgcccacgagttctcacctgatgtggtcctagtctccgccgggtttgatgctgttgaaggacatctgtctcctctgggtggctactctgtcaccgccagatgtaagcctgctgggggattgagggaggaagtgaaacagtgaggatatcgagtccagtgaggcatggggcagggaacagactgatattgcagcagacggggaaagcagggggcagggcctagacttggaatcatcttggtaactcccccaacttgtcctctgccaaccccggccttgaggggataggaggtggcagtggggtagcagaggatagaggatgtatcctgccggagctgtagagatgggcttgttggtccctggtgtttcagtgatg

SEQ ID NO: 10744 - DNA, 1251 bp, Homo sapiens
gtctgagccctcatttttggtggctaagcctgtagccctgtggcagttgaggtgccttttttttttttgagacagtcttgctctgttggccaggctggagtacagtggtgcgatctcagctcactgcgacctctgtctccccaggctcaagcaactctcttgcctgagcctattgagtagctgggtttacaggtgtgtgccaccacgcccagctaagttttgtatttttagtagagatggggtttcatcatgttgtccaggctggtctcgaactcctgacctcaggtgatccgcccgaggccacttctagagtagctctattcctcttccatgcaggccccatcagccagaagatgtatgctgtgctgccttgtgggggcatcggggtgagtagggcgtacagcagtgggggtgggcgggcggctctcctaggtctgtctcttccctgcctaccacagccgctggcccactgtccaggtgccctcccctgttcttgccctgcagggggcacactgaaacctgctctcctgccctgcaggtggacagtgacaccgtgtggaatgagatgcactcctccagtgctgtgcgcatggcagtgggctgcctgctggagctggccttcaaggtggctgcaggagagctcaaggtgagcgtgtgcttgtgacctcggtgccccttggcatggccctgctcctcagaggcagaggacaggggcagccttgggatcctttcagtgaggcactgtcctttgcaagctcaactctcaggcaccagggtgggaaggagttgccagctgggaattcaggttatgagggaccaacaaaaagacactaatgcccagtgctctcgtgggtgtctcgaggcagaaatagtgtctgcctgctcaagcctcatggttggcattcaaaatggtccgttgaggctgggcacagtggctcatacctgtaatctcaacactttgggaggccgaggtgggcagatagcttgagcccaggagttcgagaccagcctgggcaacatagtaaaacgctgtctctacaaaaaattaaccaggtgtggtggcgtgtgcttgtagtcctagctattcaggagactgaggtggaaggattgtctgagcctgggaggccaaggttgtagtgagccatgatcgcgccactgcactccagcctgggtgacaaagcaagactctgtctccaaaaaaacccataaaaaaacaaagaaaccccaacaaaattgtgcattaaacatatg

SEQ ID NO: 10745 - DNA, 1285 bp, Homo sapiens
gttctgagggtctgggaatcaggggtcgggggtagttcacagcaggcccaggtgacagccacttctcctatagcgtcgtccgtgtgtaacagcgcacccggctccggccccagctctcccaacagctcccacagcaccatcgctgagaatggctttactggctcagtccccaacatccccactgaggtacaggcctggctgggggctggtggggcggggacagagttgctccttcccatggaagaaagagtgcagctccttccagtctgtctgcctgagtgcccagcagagacctctctgcccacatgaataggctggaggatccttgcttggacttaattgcattgaaggggaatttgtcccacaggactatgaagagccctgatggctcagtctccctcagtgggagctcagggtagagggaactgggcaccattcagagaccttggccttggccccaggttgccctcccttgttgcctcccctttgtgcactctcatgcctgtctcttctgactgctccccagatgctccctcagcaccgagccctccctctggacagctcccccaaccagttcagcctctacacgtctccttctctgcccaacatctccctagggctgcaggccacggtcactgtcaccaactcacacctcactgtaagtacagggcatataccccatcttccctctggtgttgaggtcacaggtcctgcatgcccccagctggggttttccccttccaaggccctaagggagatctgttggccctacccagagcttggggggtagatagtgggtagatggggatgctagtccaaagttggcaggactgaggctgtataagcccctcccttcaccccccaggcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctggtgagtggacaggtagctgtgcaagggagggggctaaggtcaggaccaactgtcagggatactctccaaccctgtcacagttccccttagcagaatcaacagcatcagtgatttcttccacattctggaaacatgggatacctacaggatgccaggcactgttcttgacaaaatctgctgccatcttggcgttcaca

SEQ ID NO: 10746 - DNA, 1284 bp, Homo sapiens
gtcatgtacgggtacaaggggagcagagggaagatggaagtcaggccagcctcaggcccattggcatgggtaccactgcctggaggagccgcctgcccagctatacagccaggtccaggccctcctgaagggcagaaactttggacctgagtcacatggaatgctgatgttgtcactaaggctacccatcattcccctctctgtagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgcttcttctgcctccctttcttttccaccccctgctgctcctgcctaactgccctgccagtgctgtgtggccacaaaagggctcaggcaactctttttctctttttttttcttttttatatacttttagacttctaaaattttttttttgagacggagtctcgctctgtcacccaggctggagtacagtggcgctatctcggctcactgcaagctccgtctcccgggttcatgcctttcttctgcctcagcctcccaagtagctgggactacaggctcctgccaccacgcccggctgattttttttttttttttttttttttagtagagacggggtttcaccgtgttagccaggatattctcaatctcctgacctcatgatccaccccgcttggcctcccaaagtgctgggattacaggcgtgagccaccatgcccggccttagacttctaaatttatagatttatttattgcaaa

SEQ ID NO: 10747 - DNA, 1165 bp, Homo sapiens
cgcgctgaggtccccaatggggcgggccacacgcccatggactgtgcgctgcaggccgtccaggactcccccaactgggagcctgaagtccttttcgccgcactgctggactacggggcgcagccagtgcgccctgaggtgcgctgggaggccctgacataggaggctcctgtgtgggggagcccgcggctggaactgctccgcttctggggaagacagagggtccaagagactgaaagcctgccctcagtggccagggggctgtccccagcttgggagggggagagaggattctgggagagagagtccaagggagggaagagccccagaggaaaactggggccaaaaggttggagcatacttgagggtggggtagacagaggcacaaaaaagggaagagagactcagaccttagccccccagattaggctaggattggccatgtgggtgaggcaagacttgggtctgccctcgggtgggggaggcatgtgcccaagaccctcttttgacccctagatgctgaaacactgcgccaacttccctcgggccctggaagtcctgcttaatgcctatccttgtgtcccatcctgtgagacctgggtggaggcggtgctcccagagctgtggaaggtatgtttgcctcagggccgagatggggaggagggacgagccacaggcctattccttcaggaccagcctcatggagggagcagcaggagggcccctgggtagagaggatgggtagagtggcacccctgggtttcagggtaccccctcccccggtaccccaggctgacccctaactccacacacctctcctgcctccctcacttgcatcagcacagacatttatctggcatctcttaacttggtgggcactgtgctaggctctctggggtgggagtggtatagacatagtggagacccttccctgaagtggagccccagcccgcattatcactgcagggcctctatggttctgaatctgagtcctttgagacacatgaaacacccaggtgggtgcatgctgcaaaatcccaggacccccaccgctgggttgcccccagatggtagggcaagggtcatctgaccttctttcactcctggcctaggagcacgaagccttctacagctcggccctgtgcatggtgaaccagccaaggca

SEQ ID NO: 10748 - DNA, 2251 bp, Homo sapiens
ggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggtagccccggcctacctactctcattaccattttcctgggggcagcgcaaagccattctctgtcacagaaagaggctgcaggaccacaaaatggaactttattcagtcacagacactgaccctccaatagccccagaagcaagagcctagggcccagcaatccatacccagtccttggagttgggcagggtaggacgctggccaagggccagtgctgtctcttgcttacagcctgaggactacgggagcagcagctgtggcctggccgctcccaatgctgggggcttggcttggtgccccatccccttcctgactgagctctatgaaggactcttaaaaaaataaaataaaatgcaagcaa

SEQ ID NO: 10749 - DNA, 2002 bp, Homo sapiens
ctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttgactgctgtctggtcactggaatcaatgaaggttcacaggggtgacccaacaggtttgatctataaaaatgcttgaagccaatttgccttttcttcctagaactatcttcctcttccctaaagattccataggcaacctaccttcacattgttctgtgctactgttcttgcccttttctcaattccatttgttcaccttgggttgtgagaccactaaagattctgagaagttgga

SEQ ID NO: 10750 - DNA, 1210 bp, Homo sapiens
tactgccacgtccacctgtgaagtgcacttctccacgcacacgtgttcactcaaggacacacattgtccctcctggcctcatactgttccttgcagaggtcgggcactgtcccagaccatcaaagcattaactctgggtggagggttgcctaagcctcccaggcagggctcagtcacagagctcaggaggtccctcccagagataggcagcaaaacattggaggagcctgcagatgggacacgaggaagatgggatggggacagaggacacaaagaagagacacgggacaaggagacagagccagggatagatggggaagggcagcaggaaagacaagaagcacatctgcttggagaggaaacaaagtcatacacagccagttctcaaaagggggcactggccgctgccatgctatgagtagccctttttcctggttggcataccctggctgcagactcacatgcccttggtgctgtacccaaaaaagccagctgtctgcaaccactgcccaagcagagaggggtatggattgctggaactgttgacccctttgatgaggatgttggacagttgactgcacacacccaaacactctcatgggatgggagggagaggccaagctctagagtcagagccagggaaggccagaagaaactggtagagtggacaaggtgctgtcctgggggacacaagacttgggcctgttctcctggctctgccactgaaccgctgtgtatggggcctttggtaagtcatttcacttctgtgggcctggtctttatgtgaggtgagccaggtctgtgtggtccccttcaggtctaaaactgttttgtctgaggaggactgagatgggggaagaggaggctgagctctgcttctggttttctgtgggaactgtgggaaaggagcactgcctttctatgcctggtgcttctataagaggcaggggttgggctcagttgccatgagctcctggcacctgccagtgccactcttgtgagcccgcgaggatgaaagaagagatggacattgtgtgggagccaagagagaaggtcgatgaggaagagaaagagacacattggaaaggaggaacaagaaggagactatggagaagtggggaaagatgcagggagggagtgaggtgagagtggggaggctaaaaagggggtgatgaagggaagggaagccaagtggtgggaaagaatgagt

SEQ ID NO: 10751 - DNA, 1213 bp, Homo sapiens
cagtctcctcctcccgcctccccccggccggttccccccgcctccgcaacccggcggggacccggacgcagcgcagccgccgccagccccggagcggagcggccgcaccgcccccggggaccggatccggattcccgccgctcccccctcccgggctcccttcgccgtccccgcccgcacaggcgggcaagcagccggagagaagcggcctagcctgccccccgcccccgagccacccaccccggccagaggcgccgccaccgcccagccaccccgacgcgcacggaggagcccggcacagaggcgcgaccgcggcgggaaccgccgcctcctcccccgagcctgcggcccagccccgccggcgcccccgccccggcctccggggagccgagccaaggagagggcgggaggacggcggccgggaggcgggggcgcagcgctcaccggccccgccgccccctccggcggccggggagaactgcgcctgccggctccgagaagcgcgggctcctccgccagcggccggggctcggctcaggcctcgcttcctgccttcccctcccccggctctcggcgtcctcccaagtgccctggtctgctcgcgcccggtcgcctgctcggtggtcgcttcgggtccccgctgggcgcccaccgcaccccgcggttcgctcccgccgtccggccccgaccccagcgcgcgtcctcagccgcctcggttacccggcgcagcgcggcctccgggcttcccgctccagcggctccctccctggctctgagtggcggcgccctcccccgctcggccgggcacagccgcagctccctcccgcggcggcagcggctcctcctccgggcgaggcggcggcgctggggcggcggctgctgctgctgtggcggcggcggcggcggcggcggctgtggctgctgcctgctgctcctcgcggcgaaaagcacaaagcacagcgccctccgcctgcaggcagcccgcccgccgccggccccggcctcagctcgcacaccccccgccgccgccgcagcctcagccgccggagcggggaggaggagggagaagggaggaggaggagcgggagggggggcgggagaagcggggcagcgagcgcgtccttccccgtagagcgcacaccgacccccggggagcgagcgccagcccgcccgcctcgccggctccgctccctcccacagcctgcccgggcgg

SEQ ID NO: 10752 - DNA, 1239 bp, Homo sapiens
ctcacctgacaccccactgccccatctccccacctcgccgcccaggttctctgtgaaaacgctgctggagaagtacacagcggagcccatcgatgactcatcggaggagtttgtcaattttgcagccattttagagcagatcctcagccaccgcttcaaaggtgggcccagcgcccctcccccagcggtccctcccccagcgcccctcccccagtggtccctcccccagcgcccctcccccagcggtccctccccaactcccaacctttagctcccagccacctctttctgatatactccatggactctgaaccccctcattgaccctggcccccattctgggccatgcacagaagcttgtgtacagatctgggaagagggagaggcctttggcctacaatccccatcatgggcaagcgatatgctggggtgcccactgcacacgtgcatgtgtgtgcacagatctttgtgggaggaggctgcttatgcttatgcatgtgagtgcctcactacatggaccctctccaaactccctggtcttgctgagccccctccctgccctggctcagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaaggtgaggggcctgaagcaagcaactgctctctgctctggacacagggggcctgcctgtttcttggtttttgccccctgtgcacagcccaggggagaagggcccacacctgatgctggacacatgagtccctctggggcagcaagtaaaggtgaacatgatttccagggccgggcatggatccgggtggcactgatggagaagcgcatgtcagaatacatcaccacggctctgcgtgacacccggaccaccaggtcagacttcccaggcaactcagaccacaggtctcagagtgcacctgcattgcccaaacacagctgatccttaagttcctgcagcatccttcagttcctggactacaagtcccagcaccagcacacatggctgatttccctcttccagcctggcctgcagtcccaggacgaactcttttttttttttttttttttgagaaggagtttcgctcttgttgcccaggctggagtgcgatggcgcgatctcggctcactgcaacctccgcctcc

SEQ ID NO: 10753 - DNA, 2868 bp, Homo sapiens
agtgatttatccgccttggcctcccaaagtgctggctgggattacatatgtgagccaccgtgcctggcctccataaggtttttgaagggtgaccaggtgtccgcctggacccagctgctggggtactgcatgtgtagaggcagggaggcctgagggctgtgggcagaggctgagggcgtcaggcaaaggcctagcctgggccagccccatcacagacatcacttgtgtccctcctcttcccctgggctggtgcctgcttggccaggatgccttcgtgaagatcgtgaggcacgagggcaccaggaccctctggagcggcctccccgccaccctgtgagtagccgggtcctgcaccactctcctctggtacttcctgaccctttgctccctgttgaatggctaggtggggcaggtgatgctttaaaagtttgggtccttttgggagtcccagctaacctctctctgtatccccagggtgatgactgtgccagctaccgccatctacttcactgcctatgaccaactgaaggccttcctgtgtggtcgagccctgacctctgacctctacgcacccatggtggctggcgcgctggcccgccgtgagcatagtcttgggcctttgacctccctctgtccccacctcggcccaaacccagtcagtcccagctcccagccccaacctctgccagcctagggataggggggtgttctaggtccccagacctgggacagcaggtaggtgatgccatgtaagacctgtgatctcacttctccccattgtcacccccaatccccacacagtgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcaggtaggcacccaagctgcagggggtgggtgagggaaccctggggtgatgcacaaagggtctacagccaagtcccagctttgtgactagtgaccatgaagttacttagcttttctgagccatgggtttctcatctgtgaagtgggcctagcaggtagagtatttgcccaggcggtcaggagattaattcctacagagtgcctgcttctgagcctgcatgtagcagacaagactcacagctgggagggagtggtggcagtgaaaggtggacggtctggggccacttccttgcccttcccgtctctaatcagtgcatcccccaccccaagccctgtactggttcaactatgagctggtgaagagctggctcaatgggttcaggccgaaggaccagacttctgtgggcatgagctttgtggctggtggcatctcagggacggtgagtggactgggctggaggtgaggccagcggaggtctccctgcggggggcctgaggatttttggagatgcccagaagcagaccccatgaggcctttgtccctcccagccgcaagagccatctgggaggtaggggtgggggtccaggaagtggagctgagccctctccccgcccaccccaccaggtggctgcagtgctgactctaccctttgacgtggtaaagacccaacgccaggtcgctctgggagcgatggaggctgtgagaggtgagggcccagattgccgtggcaggggacaggtggggtcctgaatggggtctcactgagccggcctcgcgtttgcagtgaaccccctgcatgtggactccacctggctgctgctgcggaggatccgggccgagtcgggcaccaagggactctttgcaggtcagtgtgtgggtgtcgggggtgggggcatggcggacctgcgacctgacccctgacacgggcctcctttccactgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttctgcctggtgcctgtccctctggggcctggggtggctgggagggaggcttgggagggaccctggtgctggtttggctgcccagagtggcacctatgaagaggacctctccagtttggcgagagtcggggtgaggacctagagtgtaagggaccacaagtagacattctggtggtgaggtccctttggggacctcccccccatgttagggttagaattgggggtggtaggggctgggcacggtggctcacgcctgtaatcccagcactttgggaggccgaggcaggtggatcacaagggcaggagattgagaccatcctagccaacacggtgaaacctcgtctctactaagaatacaaaaattagctgggcatgctggtgggcgcctgtagtcccagctactcgggaggctgaggcaggagaatcccttgaacctgggaagcggagtttgcagtgagctgaaata

SEQ ID NO: 10754 - DNA, 1187 bp, Homo sapiens
cggaaccactcctgagtgaccttgggcaggccacctcgtctccccgagccttagttttccccggcggaggggggcggacagtccctgctttagaggtcattgccagggttgttgaggcaacagatgtttcgagggcggtggatgagggttgggttaaagtctcacagtgggccgggtgcggtggctcacgcctgtaatcccagtgctttgggaggctgaggcgggcggatcacgaggtcaggagatcgagatcatcttggccaacatggtgaaaccctgtctctactaaaaatgcaaaaattaactaggcgtggtggtgcgcgcctgtagtcccagctacttgggaggctgaagcaagagaaccgcttgaacgggggtggatgttgcagtgagccaagatggtgccactgcactccagcctggcaacagtgcgcagagcgagacgccgtctcaaaacaaaagtctcacagtggcccagcctcctttcctgccatccctggagttgtggtctgtttgaggtttggttttcaggactgaagcttcaagatggctgaccaggaccctgcgggcatcagccccctccagcaaatggtggcctcaggcaccggggctgtggttacctctctcttcagtaagacctaggggaggtggggtgggggcgggtggggatggggcagaccggagattggaggctgtgtggtcctgggggaggagtcctaggggtggggtcctgaaaggagccttcagacccgcttcctcccccagtgacacccctggacgtggtgaaggttcgcctgcagtctcagcggccctccatggccagcggtgagtacctgacctggaactagtgaggggtggtgcctgggcaaaagaaagatctcccagaggctggccgtggtttctcatacctgtaatcccagcgctttgggaggctgaggtgggtggatcacctgagatcaggagttcaaggccagcctggccaacgtggtgaaactctctcactactaaaactacaaaaattagccgggcttggtggcatgcgcctgtagtcccagctacctgggaggctgaggcaggagaatcgcttgaaccgggaaggtggaggttgcagtgagctgagattgtgccactatgctccagggtgggcgacagagcaagactccatctcaaaaaataaaataaaaaga

SEQ ID NO: 10755 - DNA, 1197 bp, Homo sapiens
actccactggccaccatatttcctttttcacaactttctcacccctgtggtttcccatgtcatcatgtggccgcttcccgcaaggccttagcggggtgcaggtatgaacatagtgtcaggcaaggaggcatctggaggggaaccctggcttttcctggggggactccctccctgcaccctagccctgtcctctcccatggctactgatgccttcccctcaccccagaggtggcccacatctgcacagatcagacccacaaaaatcacgtcttcctgactctcataagcctgcccagtgaggcccaggcattaggccatgtgctggggactcagacccacacatatacgcatgtcagcattcatgcttacaggtccgcacatgctggggcaagtgtcacacacggggcgctgtaggaagctgactctcagcccctgcagatttctgcctgcctggacagggaggtgttgagaaggctcaggcagtcctgggccaggaccttggcctggggctagggtactgagtgaccctagaatcaagggtggcgtgggcttaagcagttgccagacgttccttggtactttgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggtgagtgcccctcagcctaggcaagagctggcagcctgggttttcccaaagggtcatcttggattggccagaggaggacgccaggcacaagtctgtggtttatcattttccctgtctttctaggacaaatggcccacaacactgagcaggcatctgggtggcccctgccaggttgatgcccactgctctgccggccactcctgcatctttaccgtctcagggacttccagttgctgccccttcccagaggtgagcgtgccatcagcccagtggaggggcttaggtctgcatttatgcttttcctgcactctaccacctgcagataaaagggccctgccaatgcaggtttctctgtgttccacaggccgtggcatgcggggatggccatcactgctgcccacggggcttccactgcagtgcagacgggcgatcctgcttccaaagatcaggtgcagctggggtgtgg

SEQ ID NO: 10756 - DNA, 2992 bp, Homo sapiens
cccaccccctggcaaagaagctccctgcccagaggactaacagggcaggtgaggaggtgggagagcatcaggccaggggctggggcggggcctcattgactccaagtgtaggaaaaagtttcctccatcctggctgcccctcacgtttgctcctcttccagtggccttgtccagctcggtcatgtgtccggacgcacggtcccggtgccctgatggttctacctgctgtgagctgcccagtgggaagtatggctgctgcccaatgcccaacgtgagtgaggggctggagccagcttggctgtgtgcccccagccacctggccctgacacgcaccttacaggggctctgtggcatggggctggctggctgcttgctgggagcctggctgatgcagggttcatgctaccccctagtgggggattggggcagtgccagccatcagcctggctgctccctgtgtgctactgagcctggaagtgacaaagacccacccctgtccccactcaggccacctgctgctccgatcacctgcactgctgcccccaagacactgtgtgtgacctgatccagagtaagtgcctctccaaggagaacgctaccacggacctcctcactaagctgcctgcgcacacaggtaccagaggcagggtgcagatacaggggtggggccccctttcctcccttttaggcctggccttaggatcactgcaaggtggtgtaagcggtaccctccatcttcaacacctggttccagctgtggagccggcaaagggttgatacccctgagggtccccagtgccacttctgacctgtcctctctgcttccctcacagtgggggatgtgaaatgtgacatggaggtgagctgcccagatggctatacctgctgccgtctacagtcgggggcctggggctgctgcccttttacccaggtacccaggggtggcgggtgggtgggctgagcacagtgtggcaggcagccgggccccagtgcccacctgcccttcttcatctgccctaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggtatatgggaggggacagcatcttggcctgggcaggtgggtggccaagctcctattgctttctgccctccgcatagcccataggtgatacccagctctgacagattcgtccccagctggaggtgctgtaagcaggagaggcgggctggagtaggtaggggctcggcactgcgccccacatagtggctacctacaacgccctttcctgcccaccccccaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgtgagtgcctccctgcctgcccctggataggggagctaagcccagtgaggggacaggaacataatgccattctgtgctcccttccccgccaggctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccaggtcagtgccaacccccatcctggggctgggtatggccagggaccaggtcccacctcgtccaaccctctcgcccccctctgaccatccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaacagtgtctgatttgccgccctgcctgccctccccagggccccagaacaggggttcacgtccactgccaacactcccctcccctaccccacagaaagacatacacagccttaacctcaccagttttatatttgctgctgcccacatcggctgtatcacattaccccctagtccccagagctgtcccagccaccagccctgtgacatcgtagcccagagatgggctagtcagcaagcagcaccccctcccctcccaggggtccacaaagaacgccccctcccttcccagccctcacactagcagctgaggctgggtcacccctcctgctttcccacaatagagctttctatgtacagccacgtctacacaggcactgcttccccccagccctcctccccggcacctccccgtggggg

SEQ ID NO: 10757 - DNA, 1137 bp, Homo sapiens
cttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaacttagcagagtctgtcgtaattgttgccccatccactcaaagttaggtagggttggaggtgtgggttataaataacatcttgtttgacatgaccaaggaatagattcctgtgaaccagttagagatgtttgcagttgtgcttctgaaagctcaggctacgcaaagagagaggaaagatgatggtgtgggaggtggtaatagtagttaatttctctcagttgtaggtagatgtattgggatgtacacctcctttccacttcctctttcccacaagaggaaagatttccttccattttagatatataatctgtgtgtagtagaatatatggtgtatata

SEQ ID NO: 10758 - DNA, 1215 bp, Homo sapiens
aagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgctgtcttctgacttattttgattgcttctacgtacccatggaaatgaaatatgtgtgagtagttacttaggaatgtgttgatttttattttatgctttgttttgattagccctataac

SEQ ID NO: 10759 - DNA, 1240 bp, Homo sapiens
cacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgag

SEQ ID NO: 10760 - DNA, 1619 bp, Homo sapiens
acggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgct

SEQ ID NO: 10761 - DNA, 1244 bp, Homo sapiens
cccaaagtgttgggattacaggcgtgagcctctgctcccggcctaatttttgtatttttagtagagacagggttttaccatgttggccaggctggtcttgaactcctgacctcaggtaatccacccacctcggcctcccaaagtgctgggatcacaggcatgagccaccatgcccagcctcttcttccttttttagtcttgctgttttactattgaaatccccgtgatagtccattcacagattgtgttacctcttggataagtttcttgcattcccaaagccagagctatgtaagtatagacattcacatctgcctgagcactctccagttggtctgaaagttgttcctggccaaaaaatacctgaaacacctttacaccactcctcatttggaaacgtttgccaatctctcttttctcttttcctttgtcctttcagtttcttggcggatctgatggataactcagagctcatcagaaatgtgaccctttgtggacatctccaccatggcaaggtaagacggaactttcagctacttggaacaggatttctcttttgtacctgctcatgttttagcccttagagtcacagcggttgaggtttgaggtcacaaggctcaacctcctgactaggggtgctgcatgcctgttacgaagtcatactgtgaaattctggcttttcccaagcagcaggtggagcctgttcctaagccacttgcatgcctgagccttatgtctacatctggacagaagatgggaaattgagccttactctgatttttataagttttcatttcctgagggatgcctgtctaagaaagatttcatcttttatttgaaaataatcctgtggcttcagtgttaattatttgctgtcccataaccctccttgctctcctttttctctccttatccctaaattatgtggtgtattgggagctgggggaagggcacagtaaattttcctctgtggtcggcagatgttaactgtttcttcccttttagacatgttttgtggattgtttaattgaacagactcacccggaaatcagaaagcgctatgaccaagatgtaagtagaacttctgttgagggtttaggatgaaccattcagaacagatagagatgtctctctcctccttccttcacccttcctgttctctataaataatgacgcctccaaagtgcagctttataattgtgatctctattaataggctgtaagaaaataatttcaactttctc

SEQ ID NO: 10762 - DNA, 1253 bp, Homo sapiens
gacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcaggtgagaacctcagccctgcctggcagtggcctggcctccctgcctcctcctaagggaagggtttcatgtgtcttctggcatgtgcccgcctcccccaagctgggcacgatttactaaggagttttgtacaatgtcccatcatgctctgtgggacactcattcattcattcagtctatgggggaggcactctactgggcccaggactgcaacagcaaatcagacaggacagttcctgtccacttggtgcttacagtctagaggggagaagacaccactcacagatcacacccacagtgtgtggggataaaccagggtaagtggtaagagggagataactgtgagccttcaacaccaaaagctgcctcacctacagaaggaaggcatagcccgcacccatagtggagatcaggtcatcccaaatccactggcctatgggggaacagaacaaacacacagagaactccagccctgcagcgggaacatggagggtgtgattagtgggattaatggaccagggaacacaggaggaaaaggaaaggggcttgagggaggagggaagggctgagctgggtggcaaggcactggggtcctcctccttactatgtcctctgcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtcggctgcccctgccctgggccttgttctcacaaccacccggggggaagtgagcccatggggtggagtgagctggtgtgggacagggtggcaggaaatggagagctggcacccctcaaggagatagatactgctcagtgagatgctgcactagagacacccgcctgttcaccctgctg

SEQ ID NO: 10763 - DNA, 1814 bp, Homo sapiens
cagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacacacacacacacacacacacacacacggactctccgaatcagggctgggcctctgtgccaggccatcccgtctttggagtgtatcctatttgagatcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattgtggcctaaacctcctcagtggaccacgggaaatcatgttggaccaagggtttccatgttcaaacagtcaacaaggccctcccctaggttgagatattttttatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagaccaaccaagattcccagacttggcttcttcccacactgggctggagtcctcccggagctcagggggaggtgagggccccagaaggtgcacttgccatcaggcttctccctgggtcccaggaggactgcagccaggcccgaggcacctttgtgggaggtgggtagagggctgaggcagcgtcacaccttcttgccccgcctccccatctgccttccccaacccaattagaccagcgcagacataagccttccctgccagggcctgcagacttgctgatgtgttgatcctgcagccagaagcctattaaggctagaaatgagtgtgacggatgcaaatgctgtggtggccatacttagtgccccctttcccagagccgcttgtgctgagtctagctcattaacttgctgcaaacccctaaggggcaaagaagggccgggtaaggcagtggtgggctgccaggtgggtggccaggcagg

SEQ ID NO: 10764 - DNA, 4056 bp, Homo sapiens
tcccccagtgccacaggggacataggggtgagctggagcgtgggccagttttccctgggaggtctgatggacgtgtgaaccctggtgtggaggttgagtgtggggccggctgggtgtgagtctgctcccacagcacaggcggtggacccgggcccagccactcggaacttcagggatagggggtgtgggagagtctttgggccactgtcaactcagctctgcctctccctgttggctttcctaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatccagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccgtcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaaccttctgtcctggtattcctggtcagcaggtggcagtggaagaaatggagtgctggagcctaggctggagccaggacgacagggcttggacacaaagtccctcaagcccacagcaccaggccagcttccaaaggccttcctttaaggctgcccttcttccagggcaaacttggtgttgtcagacccttcccacccgccagagacgagctgctattgacccaggttcactccaagttagagcagcaactgggctctcagccagcacctgagcacctcagcacaggagccggcccaggcttccctagctgggcacagagcagcccccttggtccaggtcagcagtggctcctctggtggaggtgcaggccccgtgccttcccactgtgcccaggtgccacatctctcctcctgcac

SEQ ID NO: 10765 - DNA, 2637 bp, Homo sapiens
cgaatcttctcgtattcctgaaacagaatggtacggtccagaacccgccccatcttctctgcgattggccgtccttcctcagcgagtcgtgtgatttttcaccaatggccgctcgcgtttctttagcgaggtctaagcgatggaaggtggcggccagggagacgccccctacgcgtcctgggattggctacgtcgcacggcgcgcgagggcggcgggcccgaaagataagaactacgactcccggcgccccgcaaagggaactccgttacgcatgcgcacgggcggggcgaaaaagcttctatataaaaggggcgcagaggactgggagacagcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatggg

SEQ ID NO: 10766 - DNA, 1131 bp, Homo sapiens
cttggagactttatttctatatttaaagtattttaacatgtccgggcacagtggctcatgcctgtaatctcagcactttgggaggccgaggtgggtggatcacctgaggtcaggagttcgagaccagcctggccaacatgggtgaaaccccatctctacaaaaacataaaaattagctgggcatggtggctcatgcctgtaattccagctacttgggaggctgaggcaggagaatctcttgaacccgggaggtggaggttgcagtgagccaagatcgcgccattgtactccagcctgggtgacagagcaagactccatctcaaagaactaaaaagataataaaataaaaagtactttaacagtgacaaatgtaagataccccgaggattaaccagggtggccattgcctaggctcctgcccatcagcattccaggtaactttatgtctcatcccccttctcaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaaggtcggtgacggcacccagcatggccaacagggggagctgcagggccctggggcccaggctgcaggctggaggggctgctctgcggtggcagatggagcaaggggaggcctggtcatccatgtgggatcctaattcaaatacttgccacccaaatctgggggtacaaggggagatccagctgcggaggctcaccaagttcatggcaggtgagaactctcttctgtccataccctgggccccatccacctgcctcctaacgggccgggcctggaggctgtgggcgtcttgctgcctggctctggcctgttttactggctccatttgtccctttcctgggaaaagtgccctcactgtagcccagacccctccattccttgtggtagaccccagcacagcgggaacaggggccggcgggagttgcgcaaagagcaataacagccgggtatcaggaaatgagggaaggcaggcctcacctgttgtcttttgccccccagattgccagcg

SEQ ID NO: 10767 - DNA, 1212 bp, Homo sapiens
gcgaggcgaccagggagcggctgggatggatcgcctctcagccccgggctgggctgcggcctggcccctcgccccggagcagtggggtcggcggccaggccagcgcagtccgacgtaccccgtccaacccactcgcagcggtccgcgggcgcgccctcgcacgcgctgccggtgccgcgctcgccccgggcctccaggccgcgcactcctgctggccacacgctggctccgagcgcgcgcaggggccgcctgcttccccttcactagtgccccgcgccgccgccaggcccgcccgcctgctctgcgccccagtgcccccaggatggagctcgcctgccgcggggcggacgtgtctcctgcaggagtgcgccctggcatctgccctggcgtgaaaccctcccggcctttcatgggaagttctcaggtcacacctcaaggcggggagcaggagctaagcctgtcctcagcatgcagcggggcagtgctggccgcccgcagcatcctccctccgccctcggaccccagtcctcctctgtaattcttctgggctctccaactcgggactttatctgtcggttcaaatataacattcccatcttggaaacccatcgtggccctggcatcttgcagccactgggcaccaggcagagaggggccacttgtacgtacgtttcccacctgcccgggagcctccttagtgctgggtagcttcagaaaaagtgtttccttcctagtcgaggttaaaaagttgctctcggccctaaagggtggactggaggtatgaatgagggagaggataagtggtgaaaaggtacatacatcagcaaagtaaatggtaaaactacttttgatcgctggagacaatgaacaccaatgacttaattaaggactttaaaagcacatgaaattaaatgattagagtgaggtcatgatataaaataggagtctggagtttattccaagaaaaatgttggaaaccccttgactagaaacatggtctttctgaaagattagaaggagacagtatcttaacattagtgatgtgttttttgcttagtgtcttcatacctgtgagctccgttttccttcagatggctgtgtggtaagacagattgtagtgtcttgttttatgggcgaggcacctgaggcaggtgtgtatgagggagtgggggtggtatatatcttgcctgatgcctcatagctgggactaag

SEQ ID NO: 10768 - DNA, 1854 bp, Homo sapiens
gctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgacaaatgtgtcttgataatgacctggaaggccaggttctaatttaaacttctttgacttttccaagttccatgcccaaatgtggtggccggagaagggcaggccctgggctcagccttccctctcatcttccctcccacagagccctcctcccccaagcagaggctcacgggcacatatgtggacatcgtagtccatgtgtgccaactgcccataccccctgcagccagctgccgcttggctaccccactggtgacgt

SEQ ID NO: 10769 - DNA, 1232 bp, Homo sapiens
cctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaat

SEQ ID NO: 10770 - DNA, 4984 bp, Homo sapiens
agcatgtgtgtgtgatgtgtctgtgtgtggtgtgtgtgagcatgtgtgttgtgtgtgtggtgcatgtgtgtggcgtgtgagcgtgtgtgtgcattgtgtctgtgagcatgtgtgagtgtgtgtgtgttcagcatatataaggcatgtaactgaacacagcactttagagggctctcctggagtcagagggggtgggtaggaggagaagggaggtgggctagtgtgctgaagtatctactccttgtcatagtctgtgacaacccagactagcccatgagccaccctgttccctgcatttccaatgagacctcggtggacatgttccctgaggtgaggctgactgatgtcatttgacgatcttgatgccaaatccttttatatcaaaaacaaccagaacactctcttttctcttagtgctttcacccagatgaccacatttcatcctcccagccactctgggccaggtggcactgctggtttgaaagggaggtctcccctggagtaacttccgtgggcggattcacaccctgcccacagtcctgtcccagtcagcccaccatggtggtctccggttcctccagaattcccgcttttcagctcatccccacattcccggagggactgagagcgcagccccagggccctgctctttgggggccgtctctacacccagagaagcagcaaggcattcctaggtttctctttcagatgcagaacttcagtgttcagagatgttcccactggtcctgagagggctcagttcagctttaatgactgcgctgttgcgtgtgctctgcagagggcgggtggcccagcgtggctgactgcagttttcctgacgtggagcccgagcctgccccgctgtttattaattaaggatcactctgcttgcagaaccctgaactccccagaactgtgaggtgggagaaccccgagaggccacctggccccacttcccacctgctgcccaaaccccctctctgccttcctgacagtcaccccaactcccagtgatccccatcaaccatctgacaaggggactgagagggaagagaaaggaggggcccaaagaggaaggtaaaactgtcgggaacagcccccaaatgtgtgacagccttcagtggagttgcccactttcccttttctcctccctgcaggacctcccttctccccagtcctccccaacttctgaggttacattgagaaaagtctgcagagaggtgccagcatcacaaggtgttaaggaccacgagtttggcattttaacagatgccagagccacttgagaaatgtggtaactaagcccagagaggtacagttaacctccccagagtcacacagcaggttcatggcaaagctggactagcacaggtgtccttcccctgcagatccccttctgtgccccacatcacctccctccagtgtctgggccacctggagatgggccctcagactcacccggccagaggtgccatctcatgggagaggtctggccaggaagcatcgatatttgagatcccaagaaatgaagacttggcctgtcagatgacagacttcggtcatgggaacacgtgatctgttttacacatgcgtcccctcagcagcagctttccagaacattcccactttcttctgtagtgagaagaactctttccctgcagcctcctgcccaactcctccttcagtgtctttgcttcagtgtctttgataaaccattctgctttgcagagtgcgagctctgccttgcagggttcgcatctgcctgtgctgagtaaccaacgctaaggtcgagtggtcggtcacctctcataagagctagggttgtctcatgctgatgactaggacttgccctcaaggagaaaaataaatcaaaacaaaagcaaaaacagcaaacatgcatctcttaaagaaggctctgagtccaggtaaatttccttccactgaagcagccaggctgaattcgaattatctttgcccctgcttaaaaactaatgcaaattttcctagagaatatccactaattcctggagggggcatgggcattcctgatgcccatgagaggaccatttgctcttccctcagtatgctaaataacagaagcgacatttgttgctggaaagtatcagtgaagttaataaggtttttcttgcccagggtgagggaacagttcccaatgacaaatgctgtatgggaaggggctgtagaactgccagcccctttggtccatccgtaaagtgaactctgtggatcctggaggattccagcgtctttttttttttttctttttttttaagacagagccttgctgtcacccaggctggagtgcagtggcacgatctcagttcactgcaacctccgcctcccgggttcaagcgattctcatgtctcggcctcccgagcagcaagactacaggtgcgcaccaccatgcccgactaatttttgtattattagtagagacgggggtttcactctgttggccaggctggtctcaaactcctgacctcaggtgatccacccgcctcagcctcccaaagtgctgggattacaggcatgagccaccatgcccagccagcatctttcatttttctgtctgctttggccctttcctctctcactgtcttccttttccatttccaaagtcagtccatctcactattagcacaaaaactgctagagcgcttgtcattggtcatctctccctgcacctggctggtctgttcttggccactgaagcgtttcccccagctgttgctttaatcattttattgttattatgccttacttaagaaatggatatgagatgcatttacctgtctcttcctgccactctgcagagccagtaagatgtggtggaaagggcccaggctttggaggagggctggctggggttggatcttggctgccccctactagctgtgtgaccttgggtaagtagctggacctctctgagcctggttcggaatcatagcacctctctttcagggctgctgtaaggaatagcagtggtgtgtataaagcagagcgcacagccagcaactggcccctagccacactgctgagcacctactgtgataagctgccattgtggtgtgtgaagcaaaggggaaacatgcctgctgtagtgagcttcctgtagggcaggttgtagaaccagaggtgggttccaaggttacaaagggactcttagtgtattagtctgttctcacattactataaagacctacctgagactggatcatttataaagaaaagaggtttaattggctcacattggctgggtgcggtggctcacgcctgtaatcccagcattttgggaggccaaggccggcggatcacttgaggtcaggaatttgagaccagcctggccaacatggtgaaaccctgtctcttctaaaataaaatacaaaaattagctggccatggtggtgtgcgcctggaatcccagctactcaggaggctgaggtggaagaattgcttgagcccgggaggtggaggttgcagtgagccaagatcgccccactgcactctagcctgggcagcagactgagactctgtctcaataaaaaaaaaaaaaaagaaaagaaaaagaattgcaagaaataaattattgtttatgagctatatggtctgtggtaccttgttgtgggactgggagtcttggcgtctccctgaccctgcctgttgctgcagcaccgctcagccctgcctgctccctacctgcctcccctcggcctctcctgcctccaccgggcccctggtgcctcctctagagacagtcctcctgggaccgattgtgttctcacttacacgaggcatccaggactacagataaccagaggaaggggcgccccccccgcctgccctcctccctggcatcctcacgctgcagaggtcagagcctcatcccagccccttacctgcccctactctgtggagaaccgtggtcagttcgccaggccggatccacgaacggccttgtggaagatggtgagctcacacccagagctggctccgatgaccctgtctcctttacatgtttctaccttcccctccctaccttcccccactgctgggcgcagagtggaggcagatgaggtttaaagctcagaagggcttaaacgggttggggcgcagtggctcatgcctgtaatcccggcactttgggaggccaaggcagaggatcacttgagcccaggagttcgagaccaacctgagcaacatagtgagaccgcgtctctacaaaaaataaaataaataaaattagctttgcagggtggcatgcacctgcagtccctgctactcagaaggctgaggtgggaggatcgcttgtgcccaggagtttgaggctgcagtgagctatgctggcaccacagcactccagcctgagtaacagaatgagatcctgtctcaaaacaaacaaacaaacaaacaaaagaaggcttaaagggggctccaggtgggcttggcagcacaaagctatgaagttctatcttagacacaagttctgttactgggcctttgcaggctggcctgggtacctggctgccatagacagggaaccttccagatgagctgcaggcgtggagcacaggagccagggtgctcttcctgggctctgtccacaggcagaacgtacacagtctttgtacacgtccggcggctctggtgcctatttttgtttgtgtttttcttttgtttggggggatggatttggtttcccccgagccctctgtcctcctgtcacctggctggtgctcggcaatgttgaccagctgcctggctggagttggcagtggctaaggctgtgacagctaacatgttcctgagtcctctcatttcttcaccataatgccctgttgagtttgcagatactgtctctgtttttatctcccggggaaactgaggctcagagtggctaggccaccttcccatggtccctcagctcatgagggccacacagggcattgcggtggccttctcctc

SEQ ID NO: 10771 - DNA, 3433 bp, Homo sapiens
catcgacgcaaggctcagctcccaccacgctgtcctgcaaagcaccgaaggagtgagcacatctctcagccagggggagcagcagatgcagccaggagggaggctcaaagcacggctaagcacaggctggaggcatggagggggcgtctgaaggggggcccaccttccgctgttggagtgctcttagcatcagaggtttcagagcccggttcctcagatccgtcctcagtgggggtctgcaggggagattctggaacacatacagtgagccctcagaacggtggcctctccccagcgcccccttttgttctcaggaggaactggggagcagtgtcctgtggagctgaaaatcgctccctgtggaaacagctggaacacggcctcgcaacaaacccacaaaggggaccaaccccacctccctccctgccaacacgactgtgccccacaccagggccatcagatgaggacacaggtgatgtgcgtttgctcctgggtgaaaggacaaagtgcctcttaaccagctagtggtgccacctgaggcaaaggtttatcttccattggtcaacgggcagcaaataccagaaagccgagctacgcatgaaccttctgctttgtcattgctattaattaacaacaagtagacacctggaaaaacactcagcgatccaaccccttccttggaaaaggagtcagctcagggcagacacggtgcttacttctaagtggacattgggtggtgtttggacgccaccaagctcctttcatagaaagacctccaaggactgatggacaagctgtgagttacatttgaaatggcagccatgtgtacctacaataaaactgtcctttcagaatgggaagcctgggcaagagaggcccaaatgatcacagtggttgacagtcacgccctccaccaagaatgtccttagtaaggcagcttttgttgccttaatagaaatgagaaaactacctcctcctcctcctagaagggctgaattgtcccttccctgtggcactttggccactgggagtcaatctgccctggttattttatgggcttatcaatgcatcatgcagtatccagggctgagcaggtcaaggccttacactctggaaggttgagaattcttgagagcccaatgtatacagagctgagtgctaggtactgggaagggacaaaatgctcagaagatacagcctgtgctctgggagcacacactctcctgagggaggaaggatggccacacagagcaaaagactccagggcaggcccatggccagccgatagggtcctcctggagatgccccaccaggaagcaggagttacaggctagagagcatgggaccaaggggcaagatggctgggttcaagtcccagttccacttctttctggtcaggtggccttggacctgcctctcagggcctccgtttcctcatctgtaaaatgcgtgagatgacctcaactctacctgcctcctcctagagctcctgggagaatcccatgagtgaatgttggtaaaagcaccttcaaatcatgaggatttatacatgtggatctagttctcatccatgtaaaggaggcaaatgtttatgggggcagccctgggcttcccttcagttctgccccacctgggctgtccacaggggaccatcgtggtaaatcatggctcataccatgatgggtggacggacggatggatggatgaatgggtggatggatggatggatgattggatgaatgtattattggatagatgactggatggtgggtgaattactgaatgattagatggatgtataattgatgtataattatatggatggatatatgaattaataatttattaggtgggtgtatgaatgtgtaattggatggaggtataattggatgtagaattatatggatgtgtgtatgtataattgaatgattagatgcatgtatgaatgtataactggatggatgtgtaattggatatatgactggatggttacatggatggatggatggatggatggatggatgggtggatagatgaatggatggatggatggatggatgggtggatagatgaatggatggatggatggatgggtgatgtgtagatgattcgatgtatgtatgattgattggatgaagatatgggtggatggatggatggatggatgaatggatgatgtatagatgatatatgtatgatcaaatggataatgggatggatggaggaaggaatgatggataattggatgaatcgatggaagaatgaatgatgtagagatgtatggttagatgtatgtatgatggatgaatgatggatggaaggaaggatggatggataaatggatagatggatgagctggtgatgtgcagatgtatgattggatatatgtatgattggatggatgataggaaggatgaaggaagggatgggtggatggatggatgaatggatggatggatgaaccgagggaagaatggattatgtacagatatatgattggatggatgataggaaggatgaaggaagggatgggtggatggatggatgaatggatggatggatgaaccgagggaagaatggattatgtacagatatatgattggatgtatgtataattggatggatgatgggatggatgaagggatggatggatggatggatgggtgggtgggtggtgtatagatgactggatgtatgcatgattgggtggagggaggaagatatgggtggatggatgggtggatagatggatggatgtgatggtaacatgtaaagcttccatcagaatttctgaattctttgccagtacctcttagtcatcttccctcagctcctcctgtgcctggcactgcatgcccagaaaagcctctccagtcttcccagtggtgtctcagccatcagatcaatggttcctcagctctcagctcagtgaattcactcccctctgtatgacagaaattccttactcttcatgcacatggtggctgaatgggtttcctctgctgtctaattgtcctattcatggcttagactcaactctggaagactggaagatagagcctctagagagtcaggcagatggggcccaaatcctggctccaccacctattggttgtgtgaggctgagcgaattacctaacctctctctgcctcagttttctcccctgtataatgggcatagtagtagctccactggctcacagggcttctgtcagcatgaaattgttgaatgcttatttaaagcactttgtaccatgcctggcagatgagacgtccccaataagtggcagtgattattttcagtcattatcatgtcaccttggttgaagggcccagtgtagcactgctcatgctcaccagcaggaacttgagtattttattttatttagtgccaatggtggtgatgcagatatggaattgactgggaatcctg

SEQ ID NO: 10772 - DNA, 1147 bp, Homo sapiens
gccttgcttgctggtgctgagtgtgggcaccttcatcccgtgtgtgctctggaggcagccacccttggacagtcccgcgcacagctccacaaagccccgctccatacgattgtcctcccacacccccttcaaaagccccctcctctctctttcttcaggggccagtaggtcccagagcagccatttggctgagggaaggggcaggtcagtggacatctgatcttggtttagtatccttcattttgggggctctgggtgtggcctgggcctctggactttggccacggtgtttgttccagcccttctcctaacctgtcctttccagacactcggcatctaggttattagcacctcgcatactttctgacatgctcctcagtcctgattttgaccatcttctcttgcttcccatctgtgtcagtcaagactgcatttggctgtaagaaacagaaaccccaactaactgtggcatttacatgaagaggtttacttttctcacataatcagatgtctagacttggccagcacctcaagggtcattgatgctctcctgtctttattttctgtcatctttagtggttggattgttgcctcatggttacaaagtggctgctgcacttccaggcatcacatctgcctttgaagcaggaacaagttgcaaagtaaagtggccaaaagggccctgaaactaaatgtgtccccttaggaaagcaggagttttcttgcaagtggcaatcttctgcttatgtctcattggccagagctgggtcttacggccaccccttgctgcgagcaaggctgggacattgagcattttgccgtccaacctctttagcagaataaaccaagggggaagaacgttaatagtggcttttgagtcactagttggcagtatctgcccctctatctttccatcctccccatggagtttcaaggttcctttctcagtacttcttcaggctctgcacgttcatttggatcttgtgtcttggggtgaaaaactggcccaagtgtctccccaagcatccacctttggattaatttggaaaatggctgtcaagtgcccgcctcttgcttggtataatgctacagctttagaggacgcagcaggcatgggccttgccgctgaggttcttagcctcatgag

SEQ ID NO: 10773 - DNA, 3078 bp, Homo sapiens
agcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcat

SEQ ID NO: 10774 - DNA, 1429 bp, Homo sapiens
atctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaataaggtctccattcatggattccaaggacaagaaagtcatatagaatgtctattttttaagttctttcccacgcacccttagataatttagctcagaacaggaaatgatagtattaataaaagctggacatcaggattaacagctctctctggggccctgaaggtgagagttctcagacttgctcatttgcagttgcttctttgtgatgctggcaaaccatcctagtcccattcaaagggcaatacaaagccttgtggctgacctcacgatgcagcactcagtttgcaagaccggcaccagtgtatgcaaacctgagaaggttgggga

SEQ ID NO: 10775 - DNA, 1565 bp, Homo sapiens
cgcaggaacactagatagactggtcctaggctccaggccacaaggtttgtggcagggccttggagcaggaagcaggctggctgggactgggtcctcaaagagcaacttgtctgcctacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcat

SEQ ID NO: 10776 - DNA, 1189 bp, Homo sapiens
tgaaaagaagagaagaggtgtggttggtaattgaaggctcctaggtggataaatttgctgaagaaagcaagtaatgtcccacctgggaatcaagaaccaactgttcgtcttagcggaccatcaaggtcgtgaaagcatgcagagtttataaagtgttctcagaaagcacagttttagtatctttttaaactgtcagaagtttgatacctaggtaagcacttagagcttcaagtagttagatttcatcaatgaaaaggaagcaagtttccttacccactttgaaggtcagtgtgttagacaaatggaaatcttttaacaaactaatcaaacatccttttagtagtgtcacacaagtatctagaaaggtcttcgcaataacaaatggggagctaacttctcaataacaaatggggataacaaatgggtagctggctttttatcagatgctgaattgtcagttttgtttggcttttttcacaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatggtaagaaagaccacagactagaaagtctaatgaaagaaacttgagagacttctaggtgaaagaaaatcagccaaggtgcagttacaactcagatactttcaaggtacaactttcgtcaaccaagtcttctcttagaattttgcaaaaagactgtaacagatccaccaaaccagaaggtgccactaaaaggttgcaacttaatatgagatttccttctaactcttcaagtagctaggagggatctgggctcagttgcctctagccacagtaatctggtccaaaatacgcttagtatatctttaaaaatgttttgtctgggccaggcgtggtgggtcacgcctgtaatcccagcactttgggaggctgaggtggacggatcacctgaggtcaggagttctagaccagcctgaccaacatggtgaaaccaccgtctctactaaatataaaaaattagccagtcgtggttgtgcctgtctgtaatcccagctacttgggaggctaaggcaggagaattgcttgaacctgggaggcagaggt

SEQ ID NO: 10777 - DNA, 1314 bp, Homo sapiens
gatctccaagggctatgtttgtaaatctgtatttatgaagattcaagggagaaaacaaaagattcagggagattctgtacaagtgaatgatgtgtacaacacccttaaaattcgggtttcatagaactgattctaaggaagcccattaacatttgcaaaattcatcattttctaaccaactgtagttctctagactttatttactcgtgtgtttgatgtagaggagaactcaatcactagaacttgagtttatttattgacttttatctttcagacatgatgtagttaatgtgcaccaagaaccttacacataagcacacacaggtagattaacagacatcaagaggagacctgcttctgctctagaatgcttctttgtgtctgaacattagcaaatagaggttgaactagtataagaggctttgtttctttgtgttttcttgttgtttatttattttgtttctttgtgtgttctgagaatactcttccttccccttgtatagtcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggtcggtacagatgagagttggtcattgtcaagcagtgagccagatgctcagatagagttagtctcttgccaactttggtgttttctaaacttggctaaccaccaaggtcttctggggagctttataaaatactaggttcctgggccctgtttgctctggagttggatgttggaatcttgttttcagaaaacacaaagctcctcggtgactctgcagctagttttgaaaaccactgtcttgagctttttaatagaaatgggagagactgaaagtttaagtactgcccttaacactttgaaggagaatagtgtgccctctcaccttcactgttatcactgaaaatggcagtatagaatcctttgccctaaaaaagaatcttggccatgtgcagtggctcatgcctgtaatcccaacacttcgggaggccaaggcgggaggattgcttgagcctaggaattgaataccagcctggaaaatatagtgagaccttcatctctacaaagtatttaaaaattaagcatggtggtgcacacctgtagtcccagctattcaggaggccgaggcaggattgcttgaacccataaggttgaggctgctttgagctgtatttgtgcc

SEQ ID NO: 10778 - DNA, 1228 bp, Homo sapiens
atactgtaggcaatttgattggaatttctttgaatttatagatgttcatgagaatcgccatcctaaaaaaatgtgtcctaccatttgtatagatcttcatgctttcaggcgttattttctctgtaaagatatttaatatatcattagttttgttggtgttatgaatggtacttaatgatattttctactttattagtttttaaatattctttactgaacacttttgctgaattctttattagttttaataattcttagtgtcagttggatttcctgtatagattattcttaatgtatgttttattttggcatggacaataattttattgtcccagagaaattaaagggatttcagagaaactgtgtgccacaggatcaggatgctagaacgcagttccacttaatttgggaaatacctatttggaagtttatatccatgtgcatcctgatgagcgggaggtgtcttgtctctctcttgggtttttcttgacactagagttagtctctgcaagggcctttaaaagttaaattccactccccaccccccaatctggtatagatattactgctactcttggatttcactcagtttatttccttttaggagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggtaagggataagtatctgatgtttttaaatgctgccgaaaactatcaatatcgcttttctcacatcccctcccacctcgtaacccccataaccctcttcttaactattgcaaagtaaatggtttaatgacctgatatagtggtttaatttaagaacctgatgtggctgcgcgtggtggctcactcttgtgatcccagcactttgggaggccaaggcaggaggatcatttgagctcaggagttcgagaccagcctgggcaacatagtgagaccttgtctttacaaaaattacaaaaattagttgagcatgatagcatgtgcctgtagtcccagctacttaggaggctgaagtgggagtatcgcttgagcccacgaagtggaggttgcagtgagccaagattgtgccaccacactccagcctggacaactaagaaaggcctgtctcataaaaaggaaaacactattagaatataatgtttaact

SEQ ID NO: 10779 - DNA, 2419 bp, Homo sapiens
agtataatctatacttctagagaagtgagaagctgatgaaaactggattccctggccagaaaaatgcacagacctgtgatatttggcatactttttttagtgaacacgggaattccttactaatttttttctgtttaattattgcttagtttgatgtgtcttgctttaaatccatttatttcaacaagcttaaagagatttttttttaatggagatgatttaattttaacaatctgtgattttctctgaatcgaacttgtgttttggcacctttcaatctgtggtaacaaatgacaagaagggtgcaattcttccttcccttgtgcagggattttgcctccccctttctcccagatgaaagatatttgggtctctagaataactgtggtacagttagctccagagtgttttctttctggaggcagtttagacaacagcctcaagtagtgcttttgttaaaaatatacatgtttttaaaagtgcttgtatttctaatattcttttctcctttctcttctagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgtgagtagacctcatgcatgatagcattcttgagaaatgttggcacaaggaagaatgaatgaatcgccattatggagagaatgtgattctttgtacataggtgtctaggttctgtttgttttttccctgatgttgggtagatgagtgcatatacatgctagtgaagaaggggaagatacttttgctgtagggttgtattgttgtagtctaaatggtggtaatttccttttgaagtctaagaaaaataactaggagacatcttatgtgtaaaattgtactagtacctctttaagagtgaatttagatttcttttgaaactatatataggacatgataagttaatggcctgattgttgagattttgttgtttccagtaagcagggacaaatgctgagttgacctagttacctttgtaggaaattacagttgcttttgattgaactttcagcagagagcacacccagtcttcaattttaacacttgagattttcttacattttaaggactgacaattagaaaat

SEQ ID NO: 10780 - DNA, 1148 bp, Homo sapiens
tttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggc

SEQ ID NO: 10781 - DNA, 1233 bp, Homo sapiens
tgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttgg

SEQ ID NO: 10782 - DNA, 1830 bp, Homo sapiens
cattaacccatcttcatttcttctgatgtatttagatggatcctgaataccgtgtgagaaaattcttggccctcttaagagaagaaggagcgtaagtacatacaacatttaatgaccatcaaccaaacttaccaccctgttaaatccctgtgcctattctaagagttgctttcctagataagtttgtttccatttatttgaattcttcgctgtgttgtaggtccgagagaccaagcaaggaagttggttgtactgttggtttgctctccctgtcctgcttcgcaaaacttccttgtcacaatgcaggaaaaacttaatggtacatatttattggaacctgcttttacatgcatggagctgtgaccattttcttttgtgaagtgctcatctaatagcaaatgcatagtgggaaatgtaggataaccattaagaagcttttagtgatttttttttttttttttttgatgaatagttttttacggaccctcatctgtttttttgtgttttggtatttcttttgcagtagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctc

SEQ ID NO: 10783 - DNA, 1801 bp, Homo sapiens
ggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcctacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctgg

SEQ ID NO: 10784 - DNA, 2174 bp, Homo sapiens
atagactgaccccataaaccttttgaaactgaaggttatagtctgtgtttctgtggactagcagggagtattcttaaagtggagtcagtgattggaggttgggggaaatgtcaattttttttttttaatgtctcagagaactagctagttgtaattcctagggcaggaataaggaactcattaggaagaggcagttttggtagttaaaacttaaaggtaaaatgcagtaagctaatatcagacctattataaagttaggaaacttgagttgcattttattaaaggatatgaggatttttaagggcctttatttagggttttatctctctgaatataatacaatttttcttacttgttttcatgaaccaacaggacatatttgtcagaaaacttactgtggacttctgttttatttttaaagtgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtac

SEQ ID NO: 10785 - DNA, 1189 bp, Homo sapiens
ctggagaaagggctgaggagaaatctaaaatacatgagtataacaggtgtgaaatttcttcccttttacaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcaggtctgttttaaatgcttaatattatctttgtattttattatgtacttattttaagtaaatttctttatgttcattacagtaccttcattgttttttatatagatgttggaatttttaatagattagtttgtaattaccttttctagagaagcagactagtttattgcgttttttcctttgtttactatgttgttttctcctagaaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagtaagtatagaaaatggttatatatgcctttctagagataatttcaatttcattaaaataaatgcccatgcttaagaaggctagatctaaaagatcagtatttattatgtaatgtctatatatttattttgtcagtatttataatttatagatatagttctttcttgtgttaaggagtaatttaaattctttgcaacttctcggaataggtttatagagacccaagtcatccagacattcttacgtagagtgtgtcctattcagttgtgtctgaaaatacatatttatatttaccatgtaataggatttatttatttttctgcaatatacagagttaattactggggtgaatttttgacatcgaatatgttttataagcttgaagaatgctataaagaaaattgtgctgaattgaggacacaatgtctttaatacaaggctttttactctttggattttaattaaatttgttgcttaagttatctgtctataccagaaaaggagagaatgattaacctaaagccaaagaaaatt

SEQ ID NO: 10786 - DNA, 1231 bp, Homo sapiens
gatcataaatttccagcctctcaaatgattctaaataagtgtttgccactattgtaattaaaaaaaattttttttacaaaaaacaaattggccaggtgcagtgtctcatgcttgtgatcccatgagatgagaggattgcatgagcccaggagtttgaaaccagcctggtcaacatagtgagaccctgtctctacaaaaaaattaaaaattagctgggtgtggtggtgtgcacctgtagtcccagctactcacaaggctgatgcaagaggctcacctgagtccaggaatttgaggccatgtgaactatgattgtactactgcactctagcctgggtaacaaagcaagaccctatctctttaaagaaaggaagacagagagagggagggatgaaggaaggaaggaaaaggaaagagagagagagaaaaaatttgtgtctccatagttagatgcactttggtaatgaagaatatgtttacatgaactgctttttatattggtttttaaaaatctttaaatttgtattttaaaggcttgcagaaggggaacaaatcttatctggtggagtgtttaataagcagaaaagccatgatgatattgttactgagtttggtgattcagcttgctttactctttcattgttgggacatgtatattggtaagtaagaatgattcaaactgtcagaaaagcatttccatacaagtatgttttatagtttaaaaaacctatgttgatcagtgtttatcaaatattacttggctgagtagtacatagtctgattctatgaccttattaaaatagcagagatgctaatctaagtttgaactctccacttatccttactgataatagctacagctgccctgcctaacaattgatcatacatgttaggtttttttgtttgtttctattttttttttttttttttgagatggagtttcactcttgtcacccaggctggagtgcaatggtgtgatctcagttcactgcaacctccacctccagggttcaagcaattctcctgcctcagcctcccaagtagctgggatttcaggtgcccgacaccacgcccagctaatttttgtatttttggtagacagggttttaccatgttggccaggctggtctcaaactcctgacctcaaggtgattcacctgcctcagcctcccaaagtgctgggattacaggtgtgagccaccgtacccggccccatgttagtttattttacctt

SEQ ID NO: 10787 - DNA, 1182 bp, Homo sapiens
gaaaaaagaggaagataaaaggatctataagacttcaagttccatgagaagagggacatgtctattttgttcaatactctatgcccactgcctggcacataggcagcaaaacaaatatctgtggaatgctatgtaaaggcatctatagatgatgtgcctccctttaagaaacccaatatttgaatatttgcactcattcatacaagatcctcaagtgctccgtttggataatctggagggtatgaaaacatagccaagatcatgaattctttgggcatttgggccgctgcactgttgcaccatttagacctgtgatctgagagtgtgaaaaactcaagggatcctctgtaaagtgtctgcctttttttccctcctgggaggagccgttagaagggcaacattctcctttctcccccttggacgtgtgggtgttggggcaagggtgaggagtgacagaggtctcctgggaagaccataagatggggcaagcacaccacagtgaggagggggagtctggctatgactttagaatttcctgatcgaaatttctcctctaaagctccccaccctacttgggatctgaggttatcatcccctcccagtcccaagaacccttcttcccttgttggcagaaatctccaggaagcatgcccacaggaaccacaactcatgaatcagaagacagataattaaccgagggagtgactgagcagcttcagggatgaaccgcttcgttttacccagccctctctgctgcccacagagtgggctgctccaccccatcgcctctgctccctcttcctgaaccttggcccttcctgagtgggaccttcattgtgcctgatggagctcaggccactagtggaaatgaaggtgggagcagggaaatgactctgtttaggggaactgcctattccccgtgtgggaactgctggcatttattgaaacgtgagactctccagcaaaaaagtgatagcatctgcctttctgtccacacacacagtctcaccaaaaacactctttttttttttttgttagataattcaggtataatttatgtacagtaaaattcaccctttttagtgcatacagttctatgaattttgacaaatgcatatagtcaagtaaccattgccatcatcaagatacagaatttttccatcatcccctaaaattccccca

SEQ ID NO: 10788 - DNA, 1135 bp, Homo sapiens
ctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataacacggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgattttttttttaatttgagacaaagcctcactcttgttgcccaagctggaatgcaatggcaagatctcagttcactgcaatctctgcctctcaggttcaagccattctcctgcctcagcctccccagtagccgggattacaggcacccgccaccacacccggctaatttttgtatttttagtagagacggggtttcaccatgttggccaggctggtctcgaactcctgaccttaggcgatccaccttcctcggcctcccacagtgctgggattacaagtgtgaagcactgtgcccggccagtcatccatgattttaatggggtccaaaggc

SEQ ID NO: 10789 - DNA, 1160 bp, Homo sapiens
tacaaaaattagctgggtgtggtggcacatgcctgtaatcccagctactcaggcacctgaagcaggagaattgcttgaacctgggaggcagaagttgcagtgatcttagatcatggcactgcactccagcctgggcaacagagcaagactccatctcaaaaaaaaaaaaaaaaaaaaaaaaagccaggtgttgtggtgtgcacctgtagtcccagctactcaggaggctgaggagggaagatcacctgagtctgggaggtcgaggctgcagtgagctgtgattatgccactgcactctagcctgggtgatgaagtaagaccgtatctcaaaaaataccagtttttatgatagaatttacttagttgcagaagaggggtggcaaggggaatgttaatttggctcactgtttcctgaacctgaaagaaccaaagaattagcagtgtagtgtcaaaagttaaataaaatttcttttttgtttaggaaaataaaaatataaacattttagattatcattgtttatcttctagaggatctctgggaaagtttagaaaatgctagtggtaaacctatagcagctgtgatgaatacctggaccaaacaaatgggatttcccctcatttatgtggaagctgaacaggtaaacatataaagtctttccatttgtctgatattgtattaaatgaagttcagtacagtgtatcaagtttgcttttctgtactttaagttttctagtgacatttaaaccagccctgttactcttttatcagtaattttacagcttgcatcattaaaattatacatgcttaagagagaaaacaaaatgttacttgcttgtctagtctccagggaaaatactgtaaaatttgatataattctaaaaccaccaaatatggtttattctacaaatgcaaggttggtttaacattttttaaaaaattaggccgggcgtggtggctcacgcctgtaatcccaacactctgggaggccgtggcgggtggatcacttgaggtcgggagtttgaggccagcccggccaatgtagtaaaaccctgtctctactaaaaatacagaaattagctgagcatggtggcacacacctgtaatcccagctactctggagacttaggcaggagaattgcttgaactcgagaggtggaag

SEQ ID NO: 10790 - DNA, 1184 bp, Homo sapiens
ttgtagtgccttctagtttatgttcttttagaaatgagtaaaggagaggcttaagttgacacagtttgcaggtccggctttgaaagaatgtttgtcaaaaaccaaagctcaaactatttttgcagtttttctgaaagtatgaaaaatttcaaaacagtaacaaagccaagtccccagaaactgagtagaaatagaagttaagtggtttgttgttgttctcaaattgttgggactcttagtgtaatttttaaaagtagttcttgtataaatagcaaatgattcattctaatttttctgtaaaaagaaaaagaaaaaaataacaaaggattaaagaaggaatgttgtctgaataggatttttatgctaacagtgttctgagcttatacagtcccatttccttaaaccaaagaaattgctagcagtagataatgccaaaaatgcatgcttatgttttttggttttgtttgaagactaggttaatttatgttttttcctatcccaggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtaatggatatactaaatggagaaagaattacgcagaagttggtacttttttatgtggttaacaatataattaatatcatctttgtatctactggatgttactatatattcagcaagccagaaattaagacgtgagtcttttaagtctgctggtgaagttacatgggtcaacaacatagaaacagtagtggttatgtgtgttcgatgctaaatataatttgtgcacatggtggaaataaaagtcttttgcagaattccaaaggcctatttttagtcaagaaaagctaaagggaattttaggttgttttgttttatttatttatttatttattttatttttttgagacggagtttcattcttgttgcctaggctggagtgcaatggcgcgatctcggctcaccgcaacctccgcttcccaggttcaagtgattctcctgccttagcctcccgagtagctggga

SEQ ID NO: 10791 - DNA, 2184 bp, Homo sapiens
tgagggtggcagtggtaaattctcatgcctgaagattatgcatccttcatatagaccagtgggtattttttcataacctgtaatattaacttcttattgctagtaatgatcctgcattctgggttgttttataccaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttttcaaattcaaaaaaaatccagttccttaattcctaatttatagatcttaacagaaaaatcctgagattcattctaaatcagttctacattctcaaaactctctcagagactcttatagtcagcattcaggaatgaacttgagacttcctcagtccctagttttgaggcaccctagttcaggcaccatgctcagggctgcccttaggctctcaaatgttcttaaggcaccagtgaagcaggggcaccaaaaagactgagaaaaatgcaggtttaattgaagaactcagaattttgcaatcagaaattctggaaacaggttattttactttcagcatacatgtgatttttgtctgtaataatagttaagtagtttgaattacgttcagggagaggttatactagatgtcttccatttgcctttcagaacccctcttcatcccac

SEQ ID NO: 10792 - DNA, 1171 bp, Homo sapiens
catgagatggaaagttggatcattcttttgggaccaaggtttttgaaatttagataaacagttttattttctaccccccatcataacagccattcatttaacaaacattgagtaccagacattattaaaagttcttgggacacctcagtatacatagaagactgactactactaccatactctgaaaccttgcaattcgggggtctaacatgacaatttgggcactaagaatgatcttgatagggaaatctgtaattcctcattaagtgctaggctccacgagaaaagtggaagacttcctgttacactaagtaacatttttatagaagtcagtgaagtaaatattttgtggtttcctgaaatgcttatatcaaaaaaaaattagacattagttccccccctcgccgcccctctggtggttcagtgctctataaattatcctcagttgtggaaattcctaagatatttttatttacaaatttatcttcccttaacagcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgtgagtaacgcttatctgtttggttatattgcccagagaacaagaaatcgctttctcagatcttttgctatttgcatgggatagagctaacagtgtgataggtttctgggacctcaactttacctaaagataaaaattgtctttgtcttaaatctttctcaacacagcttgtccattcccattgatggattggaattctttttagatgactgaggtaggctgcagcagtttgggaaactttaattacgtgccataattggtaaaatctgtttggcaaatgggagtagtgtacaaattggtgctacatttgtataaaaattagggaatttgttaataggtatttccaagctctccagaaattccgattcggtacttctggagtacagctcagggaatttttttttttttttttttttggagacagtcttgctctgttgcccaggctggagtgcaatggcatgatctcggctcactgcagcctccgcctccca

SEQ ID NO: 10793 - DNA, 1242 bp, Homo sapiens
cctgccttggcctcctgagtagctgggactacaggcacgtgccaccacacccagctaatttttgtatttttagtagagatggggtttcaccatgttgaccaggctggtctcaaactcctgacctcaggtgatccacccaccttagcctcccaaagtgctgggattacaggcatgagccaccgcgcctggccgattttggactttacataactggaatcatacagcatacattctagttctgtattttgttctaaatgtttggaattcattctttttggatgtagttgaaattttttcattcttgttgtgtagtactaaatggaatcttcttccatctgaatcttgtttaacaaaggctatgctgtgatgaatgtttgtggaagagacaaaatataaaggtcttatattttatttccctggagtttaagttctaaagacattcaagagtagtcagaggacctttagagttaaaatgattctttggacaaaatcttaactagtgccatattctttcaccaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggtgaaactgagggatttttggagtagaaagtaggatatttattgtttaaacttaaagcatatctttatttttcaaaacaaaactgtaaattgtcatctacaaagattatctctagatacttgtttacttttaatgagggtaaaatatatttcttaggtttttaattacataagtcagcatgatccagagacatgtgaaagaagccaaaagagaaaagtcatctttaatttcattgcccagaaataccactcttaactctgtatttatccttgaagctttttcctatgtgcatgtgtgtgcaacaggctcttcctgtgcagattgttttataacttgtttcttcatttaatactatgttgtaaacatttcccaataatttttttttgcacctagcactgattccccataatttttaataatggcattattattctattctttggacaaaatgtcctttatgtaatgaaaatgttcttatggaaatgttgtgcttgtttt

SEQ ID NO: 10794 - DNA, 1099 bp, Homo sapiens
cagcttaagcaattctcgtgcctcagccccctgagtaggtgggactatgtgccaccatgcccagctaatttttgtattcttagtagagagaccgggtttcatcatgttggtcaggctggtcttgaactcctgacctcaagcaactcctgacctcaagtgatctgcctgcctcagcctcccagagtgctgggattacaggcatgagccatcatcatgcccggcctctatctgagtaatttattgcagactactaaaagcatttacaccaaattcttaatataaaactctaaactggagttttgaaagatattttcaaatattttgaaagatgtttcacaccatgtcctgtaaaattacagaagtatcttggtgacttttttgagttaagccatccatcagtatttctttctctggggtagtagttaacatgaattttaatctttgttttgctttgctaataactgttatattttcaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggtaagggattttcttgctggtgagaaaaggagcttgcctgcgccactggcaagaaagtagaaggtgtgggagagaaatcaatctgcctcactggaatgctttttctgattttctttctaatttattcaattaaaatgtgggggagattccaactgcaagagccagtgggaacacttgacttatggttactggttcctgaaccacttagaacagtcatggtaacccagtggggaaactatctggacttgggttgctttcttgaattgcttggggacaagaagttttgattaaggtagagagtttttggctgtaagaagtatcattgctgagtagagggcaagagggaaggaaggtaggcagcctaaatgctgagtcagtataggctaatgtaattggttaaggggaggaagttcaaataaggaaggaatggg

SEQ ID NO: 10795 - DNA, 1289 bp, Homo sapiens
ttcaaggaattctcgtgcctcagcctcctgagtagctaggattacaggcacaagccactacacctggctaatttttatatttttagtagaggtggggtttcaccatgttgaccaggctggtctcaaactgacctcaagtgatccgcctgcctcagcctcctaaattgctgggattataggcatgagccatcacgtctagccaggaaaattggggtattttcttcatagcacttcagacaacctgttaaattgttcacatgattttttaccatttcaaaccattttttcctctataattttagcccatttccaaaagggccattctaaattttaactgtctggagaccataatgaacatagccattggctcaaaggacttgaagatttcattcttggatattgtgttttcaaactcaaaccaggtctgcagacataccggttcctgagttcttatttttggcaagacattgtctatgttcttccctgtccttttcatttgaggctttaagattttcgctgtgttctttacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggaggtgagacctaagagtgcccctgactatgggtgggaattgggtagtacttttgacacctaggtctgttttccagactgttctgtctttttagtgtttaagtatatattttctcagaaagataataaagcttatacaaaaaacattgcaccttaacgttagcattgtttgtcatggtttactcatatatgtgttacactatatgtattatgggttttttgttgctgttgtttactttcctatgttagtattagggaagattattaaatggtcccagcaaaagtggaaggttttcatgtagagtatgttttcttattttctttgtagtcacatatccagagcacatccgatagaatccagttcaatgaccttcagtctttactctgtgcaactcttcaggtatggtggtgccttatgacttaataactccaggttggagaattattagtatctcagtataacaagttcgtgtacacacagaactcgaaaatggtatagatgatgcggatcagaagctgttctcagaaggctttggtctgtgattggttgattgggagaggaattccccacctgccttacctgtctgtctagaaagattcaaatcctacttatt

SEQ ID NO: 10796 - DNA, 1090 bp, Homo sapiens
gtagtagcttgtgctgctggactaatagggtaagttataccctgcttctaagagctgaatagaacttctcacagaaaatgagaaaacatggagtaaggagttttgagagtatcgcggatggcaacagttcacttttttggcacagagatttctttgcagaacgcttcatgtcctgttttgagtgttcacatgatagtttattccagaccctcaaggtgtctgtattacaccccattaaactctgatgttggtcaacaattgcctctgtctagtgacctctactgagggttttatttatctttgaaatttgctaagaaacccatagcactggtttggaaggctcaaaacattatactggtatggggctaggagctcattctcagctgtgtttgttttgcacagggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttggtaagatcttgcctccactgtcctctttcttctacttcctggaggaggggggtatgttttctttaggccattctggcaagcactgccttctggcattttttttgtttgtactttttcccatgtaggtgcttctgagtcaggcagcctcagtttttccttgagccaaatgtttgactcctcatagtgatggagagcagaacttttaaaactggaattcactgaaattccctgagtattttgggtcctaataaaatcatcagtaatgccatttccccctaattctcttctgttttctattcctttcctcatgccctattctttctttacagcagtgcttttagacgttgcctagctctagagaagatttccaaagtcaaatgtttttttgtgtgtgtgtgtgtgtgtgtgtgttttctttttgagacagagtctcactgtcgcccaggctggagtgcaatggcacaatctcggttcactgcaactgctgcctcctgggtttgagcaattctcctgtctcagcctcccg

SEQ ID NO: 10797 - DNA, 3915 bp, Homo sapiens
gcagtggtacaatcacacctcatagaagcctccagctcctgggcttaagtggccctcctgcctcagcctcccaggtggttgggactgcaggcaagcacctccatgactggctaatttttttttatttttagagacaagatctcctgttgcccaggctgggtttgaactcctgacctcaagaagttctccctccttggcctcccaaagtgctgagattaaaggcttgagccactgcacccagactgaaatacagttttaatttctttcactcttaattagttatcttactccacagatctcagtaaaattggctctttgagtttccctcgcaccctctgatgtaggtgttaataagagcaggtcaatggcacataggacaagaagaaagagtgtcaatccttgaaatgttgacaaattccattcaggcctaggagcatgtaattgtaggagtcagcattattggctctgttgggtatatgtgatctcaaagattgacctttttttccatctgttttcagatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattttcaacttcaagtcattgcagtttctttttcccagaaaacaaggggttagatgttgcatttcataaaactaaccgaagttttgtttactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgttgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttatttttattttcaacatcttgctgctttttttttttttttttgtcccaaatggtgtcacctccatggaggtgaaatggtttgaaagtcagaatgtgtggtgagaggtgtttgtgtatgtatgtgtgtggggaaaaggagggacacacatcttgaaatggatattacatagtgtaatgtgatatagatgaaacagtgtcctacaaatgaggtaaggaaaaagtatgcatggaggatgtttcgtgtttggagagtttgaagcattcctcatcagtaaaacaggaatactgactaaggttgttctgcaaatt

SEQ ID NO: 10798 - DNA, 1448 bp, Homo sapiens
ggaaggtgttagaggactccaggagctcctgcacccctccccaaatgtccatctttctcagacggggctctgtctggggagcacccacaggctgcctttggggtcccagagcctgctctgtgcactgaccccagttcctccatcctgtggccagcctagggctcatggcatgggcccccactgggggagggaggcatcttgtttcttgtggttccctgcaggccagtcctgtcctcctttccctgttctgcccactctggggaatagggaggggaggagaggagaggagagggaggatcctggaggactgggaagatctagcctaaagaggcttctctgagggccagggccctacagcatgcccctacggccaggggactgtctgccagcctcccaggcccatgccctcctggtgcccctggcactgaggcacagatcgtcaaggcaggtaccccctcaacccttcttccactggagcccctgacaccacaggtgccctggagcccttgtgtgactcagcctctgttagctgggtgggtgtcatcagcccctgcctcccaggccagaacctgagaacgggcccagggtgctgtggagatcaacttcaaaagagctaaccccttcccacactccacccacccacctacatttcctctgtgaaatctacctcagagttgtaccctcagaaggacgggtaagcaggaggccagggggtccccagggctgaggtggggagccttctacggcgaaagcctgccaccccacaatgaatccaccctgctccactgcgcgcctctcccaggtctcagctctgggtggggagcagtggccgctaccgacagcgcatgtcccgctcttatccaactcttccaggccccacctccctgcacccctcccctctatagagcaggggagtgaaggggtatgtcaggcggggaaggggccaaggacacgtcattgtaccctgagcgtccccagggagtggaaatggggaagggggcctggagaggggaggcaggggcccctgtgctctctgaacaagttgaaagtccaaataaaacttacctgttccatctgtgctcaatctgtgccctctgtggctgggggcagggcgggggacgggtagagcccttggtagcaggaggtcttggaaagtgtgtctcaagggactgtgaccatgggaggtagacactgggcaagtaggggatgcatggggcacccacattcagagcggttctggaggttcagatgtgtaagtggttgcagatgacttgtggcacggcagtcattagaacagatagatacaaagcagtcacccagccctgagcaggcctcttgaatttcccacccagtaggtctggccagtcaaggttctaaagccttggggtttatcagtaacagttatgtattcatcaaatgatttctgcttgtcaggaaccaggctgggg

SEQ ID NO: 10799 - DNA, 1389 bp, Homo sapiens
actactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctacttcctttattttgtggtttacacggttgtcctccctctaaacttactctcaggggcttctctgtcatctgactttcctcactcttgcttcccttcctaggaaaatcctcttcccctatacctgttcccacaaatggcatcccgcgcatgcttgccctattaaaggcagctgacagctgtacccactagctaacgtgtctctggtggttctggacaaaaggcctgcgggaaaactaggattctctattaatggggaattctgagagctctagggtaggaggcctcatgcaagtcttcatgaaccagaaattcctaataaaggagacgggatgcttaactcagagtccaccatcatccttgactggagcacattctgggtggatgcaggggtgacccggggaaggtggctgttcaacattccttctcggacttgaa

SEQ ID NO: 10800 - DNA, 1106 bp, Homo sapiens
acatctggtagtcctctagaaagggacaccaggcccctgtgtttacttgaagccacctgcctggggaatcacagatctcctcctccctggccacccttgtcagatgcatcccagcaacttccttcaagaggccctgggatgaggggtgagggtgggagagtgacctggctagaaaactccacagagcactgaaacctctgcttctccttataggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctctcttttttttttttttacttaatctagctagaatctatttctgttgattacaacttaactaactcatttacggataggacttt

SEQ ID NO: 10801 - DNA, 1181 bp, Homo sapiens
ccacccctttatgcaaatgaaatggtaccacaggctgatgcaagcctggccactgctaagtaattctgcatgacaattcgctcttgcttgccatggccagcttcctccaaaccaagttttaaggggtccaatccccaaagctagaggtgtctcctgatgttccccttctttcttatgtaggggggaggcggccctgccttttgtctgggtgtgtcttggtccagatcctaatcctttgcacccttatggtgatagtcacactaatggttttgctagtggctctttttttttgtgggaaggggatagtgtctggaagtagatgaatgaacacttgctggtgcagggaccagggggtaaaggctggcaggtgaagagctgggaggggccccacccaggactaactggggtgacactaggagggaactctgaggggcaggacaaggaagggaccttgggatcttagagctaaagtcatgtgatctgtctttcaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtaccatcgcccctgctcactgggctctcttcttgtccctactaccctgacacaaaccaggctggagttcttccagaaacttcctttagagaagacaggtggtgtgtggggtggacctgaatttctgttttgggttggggtctgtaagtcacagtggctgagccttggaaggggggagtggaaagcagcagatgcagaatggccaggccgtggcaacagacagtgcaagggaggcagagcatgtagcatcttcctgcttgcttcaggactctttcactctcttctgttgtttctgggagtttgggactcggggccagccattagcctgggaatgggagggagactgcagggcttcagccattctgggaaagaagcttcagccccaggcagccaaggcccaggtcaatcagacttacagttcctgttgccacaggtgcctagtggggaggaccagacggccctgtccctggaagagtg

SEQ ID NO: 10802 - DNA, 2138 bp, Homo sapiens
cctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaagtgcactttttccccactttgaatttaaattgagaa

SEQ ID NO: 10803 - DNA, 1778 bp, Homo sapiens
tgttcagatgtgattggttaagtccattgacctggcttttgacatacacgaatccccagagggaattttcaacaggagagttaactctgaggatgtcacttgacatacaattgccagtaaatgctgcttgggccacgttttcattgttccctagcctatttttctaaaattaccatttttaaagcactgtcccctgggttatccaacttaggatagaccaccagcacctggtctcaaagtctctctttgctttattctgcaggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatt

SEQ ID NO: 10804 - DNA, 1195 bp, Homo sapiens
ctacaaggtgtaactagaaattgttttcaagattggtgcttttgcaccattgattagacgaggcaaccaagtgcatttattttgatgcatgcctgtcttgttcctctaatcaactcccaagaacagggacagactgggcatggtggctcatgcctgtaatcccagcactttgggaggccgaggcgggcagatcacctgaggtcaagggatcgagaccagcctgaccaacatggtgaaatcccgtttctattaaaaatacaaaaattagctgggcgtggtcgtgggtgcctgtaatcccagctacttgggaggctgaggcacgagaatcacttgaacccgggaagtggaggttacagtgaaccgagattgcaccactgcgctccagcctgggatacagagcaagactcgtctaaaaaaaaaaaagaagaagaagaagaacagggacagatttctgttcattctcctcagtgcaaatctctggccccagctttcctcatcattattcaaacccaacatatattcggcatttactataagcaagtgctgttattaagcccatttatagatgagggagccaaggcttagcaaggataaagacttgaaggccgcacagctgcagaaggtcaggctggaccagggtttatgttgttaacactaaattgtttggagaaacagcaaacccagctgtgggggaatgggaggggtgggtgtggagcctgaggctaacttcctcccacccagccattctgtcctctctgcaataaaattcatagtccaggaaattccctgcaagtgacaatgactcttaaactttcctgaagataagaattgctgggccagagcctccttcactgcttgccatcccttcagctgatggtcagtaactctttctttgccagtagcctgcctggccttccagtttaccagagaggccctggtgatgaaccaggcccacctcccatcttccggaacccatccctgccacctcacccaaccccaccctccttccctctttcactctgggagtttttgcagttcatctgctcagccaaagagaagtaactgctaatgttaagccgaaatttgggtcaggccaggaggcacctttaaaataaaaaatttactcgggtacaggaaacagctataaatgatcttggaaatgcaggcactccatctggttacacactccaggcaa

SEQ ID NO: 10805 - DNA, 1376 bp, Homo sapiens
tatctgtcataactttgtttttattgtggtaagaacacaatgtgagatctagcttctttttttttttttcattttaaacaagaagtttatttaaacaacaagacgcttgacttgaagggaaaactatgtaggattcttttttgttttagagtaatttatccttacttaaagacagattaccctacatgtaacagctacgtacaaaaaagttataaaattgtccttggttttacaatgataaatgaaaaacattaaaattctccaattgaacaaggtatgcaaggatttttatgttgttgttgttgttttgttgttgttgttaaaacagtgagagcaaaataacttactggaatataaagataggagctgaatgagcatgccactaatggagaaagggggtattttcacagaatcagtatttttccccatcccgtctccccttgatgtcagtcaaaacataccattggctgtttagttaaaaaaaaaaaatgcaatatgcttgtgcacatataccagttactttacgtacaataaaggaatggggaagggggaaatgaaagaacagagaaaactatacggtagtagtcaggatgtggtggaaccaaattgcagttttctaattgagaatgtaatcttggtctttaaagaacagagttctggagtaaagaagcaggttcccttttcagtagacacctcccgtctgctgttggaacacatcaattgtatcttcatcctccatttccaactgtgcaggtgtgtctgtttcattgactggttgcccgtcgaatgggaatctgatctacctcattgacaatccctgttgttcacaataggctttcattagtttactgagtggtgtatgcctcttaatcttaaactgcaccatagaaccatcctgccccgccaccttcaaattaatatgatcgttgttctgtcttgactccttccttgggcttttcgtcggccatggcgagcactgaagtctcctcagctgccgcttcacaaaagaggtaccaggtccgcaccaaatgagcacacaagcagcaccagaagcggcagaagaaggcgagatctagcttcttaacaaaattttaagtgtaacatctccttttaatttggataaaatagtaggtattgggccgggcgcggtggctcatgcctgtaatcccagcactttgggaggctgagatgggtggatcacctgtggtcagaattcgagaccagtctggccaacctggtgaaaccccgtctctactaaaaatacaaaattagccgggtgcggtggcgcgcacctgtaattccagctactcgggaggctgaggcaggagaatcgcttgaacccaggaggcagaggttgcagtgagccaagatcgcac

SEQ ID NO: 10806 - DNA, 2655 bp, Homo sapiens
atcttccatccccttgtctcctttccccacaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggaggaagtgcctgtgggtgtgggagggcttgtgtaaaggacgaatgggatcatcttgtcaaccacacctcacctaggcctggaactgttagggagaaggaaagtgccatgaattgtctggaaaccgaagacttgcataacatggtggaagggcagggctgggtggggagagcaggacaagttttctcattggaaatggggtccatgctctggcagtcagtgacatcttagtttgagtggtttccaaagacagacctattccagagcttggagtgagcatgtcctacaaggataggcagaggaagagatgggcccaggctatatcctgctaaaggaagggtctcagtatggaaaaaccattgagttttcagatttccagtactaaactagcacttttaggatcttagcctttagaccataaggactttgggagccttaaacaactctggcctcttccctcatcaccacttctacttgctataggagattcttgctttctgatgcagaggcttttactcttggctgaccac

SEQ ID NO: 10807 - DNA, 1686 bp, Homo sapiens
tcggctcactgcaacctccgcctcctgggttcaaatgattcttctgcctcagcctcctgagtagctgggattacaggtacctgccactggcgccctgctagttcttgtatttttagtggagatggggtttcaccatgttggctaggctggtctcgaactctcggcctcccaaaatgctgggattacaggcgtgagccaccgcgcccagccaagacctcatctcctaaaaaaaaaaaaaaggaaagtgataacaaaagattactagccatactcattgcagatttcatgaagagagggtgagcatttgaagcatttcagtttgctattctttgggggttggagaatgcattccaatctacctaaaagtgccctttccctggctgtttgggtgataacattttttgagctttggcagaggttttaaactctgtatgtgggctggatatgtgatctacacactgttttgtaggttttctttttctctgatttcaattagaatcagaaaacttggcagtattgggtttgaattgccacttggcaataatagtcagctgggttgccccctttaaaatagataagcattctctagtttgccacaggtgacactacccccattgcctcttcagctcactcattcacatttcctgatgggcatctgcaggtgtatctttgaccgctgtctggatgttggaatgagtggttcgctgagcagacagcctgactcctgtgtatctcccatgattgtccaagcatcacttattgctccttgaccctgtctttttactgacgtagttgagtgttgtgcagccttttattttagaggcagggtctcgctctgtcacccaggctggagtacagtggtgcacaatcacagctcactgcagccttgaactcctgggctcaagtgatcctcctgcctcagcctcccaaggattataggcgattgccaccatgccctgctaattttttatttttagtaaagataaggtcttgctgtgttgcccaggctggtctctaacccctgggctcaagcagtcttctcaatgtgggcatcccaaaagtgttgcgattatgggtatgagccattgcgcctggcagttgtgcagtcttctaaattttctgtcagtatcctgcccagggcagagctgaaactgtgttgttaggtctgattctgccaagggtcgttaagcaactcttccttacctcagagatgacctgatcagagccatcaagaaactaaaggcacttggcactggcttcggcatcatccctgtgggcggcacttacctcattcagtctgttccagctgagctcaatatggatcacaccgtggtgctgcagctggcagaggtactggtgcaccttcgagtgtgtgtgtgtgcaagggacagtctgtgaggcaagtctggagcagttctcagctcgtgctccccattatgcaggtcttttgctgagactatccagtggatgaactactcaggcctgtgcttgttcagcagacatttattgagcagctacagtgcaaagcactgggccaggctgtggggcatataaagatgataaaattcctgctctcaaggagcttacagtctagtcaggtagacagacatgcagacaactaactagatttctttgggtagccagactctttgatgtcttttgaaactactttatggattcttcaaa

SEQ ID NO: 10808 - DNA, 6791 bp, Homo sapiens
atggttcatttcttgaccttaatgtttttccaatcttcttccccctacttgggtaattgattaaaatacctccatttacggcctctttctatatttacactaatttttttatctttattgctaccagaaaaaaatgcgaacgaatgcattgctttgcttacagtattgactcaagggaaaagaactgtcagtatctgtagattaattccaatcactccctaaccaataggtacaatacggaatgaagaagaggggaaaatggggagaaagatggttaaaatacataataatccacgtttaaaaggagcgcacttgtggctgatctatgccagatcaccatcttcaaattggcacaactgaaatttccccactctgttggggcttccccaccacattcatgtccctctcccgtgtaggtttcacattatgtccaggtgcacataggtggtattgaatgctcagcagggtaggggctgaccactgtccctgattcccatcgttctcaggcggattttatatttttttaaagtctattttaatgattggatatgagcactgggaaggggacgctaactccccttgataaagtctcggttccatggaggacttgagtggccccaaaggctgccacggtgccctcaccccagcccatgtgctcccataagggctggttcctagaggcaggggttgtggggcactcccagccacggcactgttaccttggtggtgggacttggaacccaaccctgagctcccgataaagctaaagtccatcatctggcaaattcagtaaattggagagtacttgcttctgtttgtatctgagaggaatttttaactgacggcttctgtctccatgaatcattatcagcatgatgaaaggtgtgtctaaaaaacaattcagaataccagcagcattgtacagcaaggggtaaataagcttaatttattaatttaccaggcttaattaagatcccatggagtgtttagcccttgtgggagacagaagccatcagttaaatgaggttaggcctctcctcctaatatactgattgacaatgcatattagccaggtaatgcactttagctaccctggacaatgctatcaagtgtgctgggaagggaggaaggcctctctacatatggaaaagcccatgcgtggagttcccctcctttcaacattgcaacaacagtaacaacaagacaaccgcaacatgtgggcgtagtcaggcaatgctgtgtgcgaagtaaactacctcaaggtatgaagttacctcagcaattattttcctttttgttccccccaaccccattaaaaaaatttttttttgatttttgtttttttgcagcttgctgatattttatataaaaaagaaaagcaaagcaaaagagaagctgatagtcttgaatattttatttttttaatgaaaagaaaaaacaagaaagttatgtttcataatttcttacaacatgagccagtaaccctttaggaactctctatggagaacaggcctggtgggaaaggctttgggggctgcccccttaggaggaggctagtgctaagagggaaggcccaggtttgagagagcccagaggggcagagcccagagccttgtttggccctgatctctgacttctagagccccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttttgttattgtttcatttcagttccgtcttgctattcttcctaatctatatccatagatctaaggggcaaacagatactagttaactgcccccacctctgtctccctgtcttctttagatcggtctgattgattttaaaagtggacccaaacttagggaattcttgatttagggtggctggtggcaaggaggggcaggggatatggggacgtgactgggacaggttcctgccttatcattttctccctaggacattcccttgtagcccccagaattgtctggcccaaattgaatagaagcagaaaaacatttagggataacatcaggccagtagaattaagcctctccacctgtcccaaccataaaaagggtctcccagctttccatctctggctctatatgctttatcccaaaacaaagcagataacgttcagacgtcggccatttagtaatttaaagcgaatttccagcagcaagcatgctttgatatctggttcagactatcatcaggaagaaaaaaaaatcccacagtacctgaaatgtgattgttgcagtgttcagtttccttgggggcctgctcccttcacaccttgagcccaagtccttttccgttggctgattcagctcccagaagagacgaggaagtgtgtggcaagggactggaaaacttcacttgcttggattaggcaaggctccactcattgttgatatttgcccagcaggaaaatcatgtaagttataccaccagaaagcaaaaggagcatggtttggtggttaaggtttagtgggatgaaggacctgtcttggtgggccgggccctcttgtgccccgtaggctaggtcttagggcaactccttgccctcctgctcagcacctccatttccccatccttggtgagataacaagctatcgcgaaaagcacttgggagatttggatgatttgagaagagtgacttaaaaaaaatgcttctgtgctctaagatatatatgtgtgtgtgtgtgctacatatatatttttaagaaaggaccatctctttaggatatatttttaaattctttgaaacacataaccaaaatggtttgattcactgactgactttgaagctgcatctgccagttacaccccaaatggctttaatcccctctcgggtctggttgccttttgcagtttgggttgtggactcagctcctgtgaggggtctggttaggagagagccatttttaaggacagggagttttatagcccttttctactttcctcccctcctcccagtccttatcaatcttttttcctttttcctgaccccctccttctggaggcagttgggagctatccttgtttatgcctcactattggcagaaaagaccccatttaaaacccagagaacactggagggggatgctctagttggttctgtgtccattttcctctgtgccaaagacagacagacagaggctgagagaggctgttcctgaatcaaagcaatagccagctttcgacacatacctggctgtctgaggaggaaggcctcctggaaactgggagctaagggcgaggcccttcccttcagaggctcctgggggattagggtgtggtgtttgccaagccaaggggtagggagccgagaaattggtctgtcggctcctggttgcactttggggaaggagaggaagtttggggctccaggtagctccctgttgtgggactgctctgtcccctgcccctactgcagagatagcactgccgagttcccttcaggcctggcagacgggcagtgaggaggggcctcagttagctctcaagggtgccttcccctcctcccaacccagacataccctctgccaaactgggaaccagcagtgctagtaactacctcacagagccccagagggcctgcttgagccttcttgctccacaggagaagctggtgcctctaggcaaccccttcctcccacctctcatcaggggtgggggttctcctttctttcccctgaagtgtttatggggagatcctagtggctttgccattcaaaccactcgactgtttgcctgtttcttgaaaaccagtagaagggaaacagcacagcctgtcacagtaattgcaggaagattgaagaaaaatcctcatcaatgccaggggacataaaagccatttcccttccaaatactcgacaatttagatgcagaacatttctctgtattcagacttagagtaacaccagctgaaaactgcagtttctttcctttggatacataaggcttctctatcggggtacgggacagggaggaggcctcatgtctgaagggggatttaggggcgagagccccagccctgaccctcggtcctgtgcaccgctttggggcacagtctgatggcgcctttgctggcgccttagtatggttgactccggatggacaaaagaaaaaaaattttttttcttgaatgaaatagcaggaagctcctcgggagcatgtgttttgattaaccgcaggtgatggatgctacgagtataaatggattaactacctcaatccttacagtaagattggaactaagggcagggactcatgcataagggtatgaatcccagccaggacaagtgagttgaggcttgtgccacaaaaggtttgtccttggggaacaggcaggcctgccaggatcccccccatatcgattgggctgggagggctggccatgaggtccccactttctgctttccttgcccatgtgtcacccctttggcctccagcttgtccctctctcactttctatagctttgttggaccagatggtgaggaaaggaatggcctcttcccttctagagggggctggctggagtgagacctggggcttggcctggaacccaccacacagccccaaagtcaggaagcctggggaaaccagagctgagacctcttcaacagggtttctttgagatcctacacctccattgggccctttttcagtcttcaatgggggcccagttggctctagaaggagaagaggtgaagcaggatcctttgccctgggggagtctgagggcgcggtccttggactcattcaggccgtctttgtagttgggggagttccactgggcgatcccagcccctccccacccaccctctaatggacctcctcatagaagccccatttcacttttgttttatctacctcttagcaaaacaatagataaattaggtagtggcagctccacttgcttaggttagggggggaaaaagatttctttttccaaaggaaaaaaatattaccttgagaatactttccaaaaaataaaattaaaaaaaaaaaaaccaaaaaaaaaaatttttttttaaaagggagacattttccagtgaccactggattgttttaatttcccaagcttttttttcccccataaataagtttcactctttggcgattttcttcacttgtttaagataacgtgctagctattccaacaggtaacagctttcacagtctgcccctggcctgtctcaccccatcccccaccctattcctgccagtgagtccttcctgtgcttctctcccttctcccctcccagccagctgacttcagtcacccctgtcccccctcccctgccaataagctcccccaggaataaaggctttgttttggggatgcttaaatcttgactggcacttcccggctgtgggggctggggagccacttgtaacatttctgtgcagattttatgttagccactgctatgtaaaagcacgttcaaaatgaatttcagcagattatgtgttaccataatgaataaacgtcctctatcaccatttggagtctcccttttctccaggatcttgatcctggtccccaaaaccagagtgaatcaaaagagcttcctcccctgaggcaaagtggatttgtaagcagttctgaaacatcacttactcagaagagggaacgatgtattttgatgagtgcaaattgggaagagctggaggcctactgcttgggacagttttttttttttttttttttttaaatatgagtgctagcttattctgtaattgcggcaactttgaaaattgtattttactggaaatctgccagccatcaccacccgattttgattgtatccttcctcccatcctttaatctgttcattgctttgggggaggtggggcagctggctcacacgttggagtttgttctttgatggatgaacgaacactccagttttctttcccgtgaaggttgtttcagccacaaaccacttcattttgctgtttcaatttcaaaataaaaggaaacttatattgaaagacaagtatgtctgtgtctcagggtttttgggtctgggagctgagatgctcagcctcagcatgggagccctggttctcagggacctgagtcatccaaatgcaaagtaggcatttttcttaaatgtacagaggagtggtttttaaatggtgccctgctcttaattagctttgcatattgggaggggggcaggtcaggtgtttggaatgaggactccagcattaaagaagatgttgggacatcactgcagagaagtagctgtccaagaagtgacgagggtgtgtcactcttcctaacacctaccctaagaaaaaaacatgtaagtgacttgtgtttctgggtttcctgtaaagggaaaggtctattctgaccctgccctctccatttttttttcccccaatttggggttttttgtttgtttgttttttgagggtatcactctgtcacccaggctggagtgcactggtgtgattttg

SEQ ID NO: 10809 - DNA, 1699 bp, Homo sapiens
caagtcctctaggtcaggcacttcctcctgaccagtgcaacgggcactccaggttagaaactgtgtgtgctccctctctgtcagttacttgtctaagggctcctatccgtggtcatcagctctctggccatgagttctgtttgtgcttattgcagcagcatcttcacaacaaacaggtcagtaatcaacctgggaagggaaaagacgacagtaaatattaccccctgtagagccgggaggcatttacacctggaatggccttcttaactgatttctgcctggccacctcacccccagccaagtctgaacctgagcaataccaggcacagagaggtgtctacttgtaactccaacacttgacaaaaaacaaaactgaagctgtgattggtttaggcagcaagtggccaggtgcaacttgtttgtttttatttttgttttccccaacagtactgagatcacttgcacttttcctcatttcttaagaaaatccagtttgcttgccatgacttgtttagcgttaggtttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacctctctgcggagacgcaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaaaaaaaaaaaaaaaagcagccatatcccctgtgtgtctttcttcatttcttccttaccctcaggtgacaacattttgaggtccccctggctaacaaattgccctttttgagaaaaatgaacaatcctgcagtcctcttctgctgttatttgttgtttctagtgatggtaataggctgacctacctcaaaccctgcctgatctcttcatgaataacatgttttcaaggctgttaaccaaaggcagagtgattagttctctctttgcagcgctgtttggtttcagtaacactagtttgttcagccgagcaataatctgaaagtatccttgagaacagtgtttggaaaaaggatcaggattgggttctgaaccaatttgaagaaaaatcaacacagatggaaacagcttacaaagtacagtcagtgaaaagcaataattataaaatatggtacttgggatgaggcatctttcc

SEQ ID NO: 10810 - DNA, 2926 bp, Homo sapiens
aaattacttaagagttttttttttttttttttttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaacaaactgtttcttgttcactagatagaatctgtattgtagtaagaaactacttacaaggtggctttctttctgctttgttactctatgtattactcaataatatatgtatggtcacaggttcctggagttgttttatttctttatgacagacacatgagtatgcacctctctctaatcctctgatgtcactgcagcttcagtctctctcactctgtttttgagtgccttcaaaatgccagcatcctggaacattcttttcctgatctaaatcctacctctgactatttcattatccatgaatattggaattcacccatattccaatgggcttaactctacaaactagctaaaaccttggacaagaattttgaccgtatttctgttttgttcctccatgtcatttttaggttatatttttaacttttatttatatcttatttcttcacatatttcgtctctctgttgaaagattttatccttatttgactcttcactttttttactttcaccagaaatttgacgttcctttaaaattaaaggtcattgaatgtcttttgaacacctttttctcaactgaagtcttcctgaatgcctcccctttctgatgaaaggatcctgagtgctgctgttgctctgccctgttcccatgtgcccactcccttccgtacacattttgcaagactatactctttattttagtcaaattaatttaaaattgctccctgggtttctgctctctcatggccctgtccctcaaaaacttctgtttactttttctagctgttttcatctaatttgtttaaaatgtatgatggatccataatatatgaaggatgtaatgaaaaggaggttgcagtgttttatataatatgatcgagcacctccgtgatgaaacatttagcaattggctagtccttcacagccagagtggaagtttgtgctgtggacaggtctttttactcccttccagttctcctccaaaactggagaaaaaggaaaaaaaaaaagaactctttcaaatgaggagatttgattgcatttttttaggtgaatgaaagcttggagttgagcatttgggccttagtcagcatttttcctttctgacttaaaatctcatgtccttttccttaaagttaatagtactcaggtttttaagactaataaccacacaaggtgggtatctaagaaggcagctgttaatacattctccatctttcctgtctggcaacaggaaagatattattggtgagatagtgcaaaattgtgagaattggttatgtttgatgatgaataaattcaagatttttgaaggcttcactgctatttgggatgggaaggtgagtttacaaaatgaaaaaggtagatttttatgttacagaaatcagtaacgggtttcttgttgtgttaattacctttcacttgatttgccatgatgtttcttcctcattattgatctagaagtttgcctcttggatagtaactagtaacttagtatctactttaaaatttgtggcttttctcttcagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaag

SEQ ID NO: 10811 - DNA, 3251 bp, Homo sapiens
cttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatatcattatttcatggtcaagcctgtagtattaaaatgatttttttaaaagatgtaaactgtgcttagttaattggttatattttgttctgttttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctt

SEQ ID NO: 10812 - DNA, 1549 bp, Homo sapiens
gtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcaggtaggtttcatcaccgagagggaaaacttttcaggatagaacctggctgttcagattcatctggtatccgcccaagagaataaatgcaatagaggctgaagggacagttttcaccaatttatcatttgaaaagctcctgctttggtcttttctaaaccaaggcttttatttcaaaagcattaaatttgacgctggactagtgggaacccaggcacactggaagggggatctgttatagttgattgaccaggaggttaaaatcaacaccaactttgcactgagattcactgttgtaggacgtgtaatagaattcattctggcatcttctctgtggaggtaggagttactgattaaaggttaggagtagagaaaggtccctttctgggtttacaaggatgccagattctagtacagctgatggggacaaaaaccataatgactcagaccggtggaaatggaagatcttcagcagtgagtttgcttttaccattggagagatgacaacactaaatttgccaagaggctgagcccatgggaatatgcaaactttaagcagaggctgagctggtcgaaaatgttgcccacctggcagtagggttacataatgccactgtacagtattgttaaggtaacaaaataacggtattcaaaccaggctgttgtcgtgaaaggactatattgtgataggttaaagaggtatgct

SEQ ID NO: 10813 - DNA, 2058 bp, Homo sapiens
cccggccctgtcctggctttgatgaagtcctttagacttaaggctggaggaaaagatgagccttgaggattgattccacctttcttttgcttctgttttccttggccttggcttctcctggctcagagtagggttgttaaactagattgcaattaatattaatgaggactttgaaataagacaaatattcctgcagccaacagagatgtatccctcccgtgacaaggagtgagcatgaaaggataggggaggactggtgggcaatgtgctctgcttccccccgcttcccccgctagccatcaggaggaagtaaactccccgagttccttcaggagcctgggaaggtggctttctggtgaagggcctttggttgtagcctgacatgcggtgccctgaggtttgatctttgtctccacctccattcttttaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcattcagagactgcccttctcacgggctctatgcctgcactgggaaggaaacaaatgtgtataaactgctgtcaataaatgacacccagaccttccggctcagccatgggttggttttttgtttgtgggagccgtgggatcagaacagagtgttctagcagtttttgtgtgtacatgtttgcattgccagctgggacagagtctccagtaaggcagaaaatgctttgttttcagaaaacactttgtgttgtgttccagatccatccccaacccgaagggaatctctgtggtagcaggtgaggtttgtcatgggataggcagtgaaggtaggtggagggcagttaacttgttctgtgtgttttggtgccactactcactgggagttacaggcctgcccgccaactgccagcaacaccttcccccaatgctagggaagtggttgacgtaaataatgtgtccggtagccctcagttagatggcttggggcactctgcagtaggtttttttttttctcttgttttcttttcctttctttctttttttcttttctttttttttttttttttttttttttttt

SEQ ID NO: 10814 - DNA, 1957 bp, Homo sapiens
gcgcatcctcttccggcctgtcgccagccagcttcctcgcatcttcaccagcatcggagaggactatgatgagcgtgtgctgccgtccatcacaactgagatcctcaagtcagtggtggtgagtgaacaggggcctttagcctcgagcccagagcaccaccctgggagggtgccaggtggcaggaagcgcttggcagtgggttggttgggatgtggctgctagtttcctggttccttttctgcttcctcattaacctgacctgcccttctgctcctccctttgaaaccaggctcgctttgatgctggagaactaatcacccagagagagctggtctccaggcaggtgagcgacgaccttacagagcgagccgccacctttgggctcatcctggatgacgtgtccttggtaagatccttcgggagaccgaggaggggaaggggctgcagttctcgtttaggtgcctggctccatttctgggtagacgctattaggtcctcccttctgctttgctagatgtgagacttgaaaacacggaaacatgctgaggtgaggcagtctccgtgggtttttcagttgagggttcttttaccttccccctgccacacacatttttcttatgacctctggttgtatccagatagtctctaaccactaaatgttttaccttctccaaactgttacccagagagtgatgccttgttaaccctgtttgacacaggcagaaactgcctggtagagaccagagaacagctcgggtagtccttctccctagcacagacctcccagcctgactcctgggagcttcctaacactttacagtccgaagctcagtgaagtaagctctgggaaccccagtgaaaggtgatagagtgtaaacgaacggttggattcccccaggcctggtatagggggcaagggacatctctgaggcgtaagctatcctcttgagacactatagcttgtgtgtttatatgacattggatgtcataactcagaaagcaatgcaggcaggatagcgtttcaggttgaggagggtgaggggaaggggtcgtgtttctagattctctgggaaaaaccatttggagtgatttgttcgggcagtgaggtaaagtgtttcctgttcagttctcccgtgcattgctagggaaaggcactgcctcccccggcatctgtgcagctgtttaaacagccacttgacaacacccagtgctaacccctgggcactgctccaccttgctccgcctgctggaagtcctgggggcttggggctccctctgctggcaagaggccaggctgcagccattctgtgggcccttccctcgtaattaccgttaacctgaacaccttggctgtgagaaaacgctgagtaaaaacctaagggaaaagttggcattttactagactttaaccacatactccattctggggaaatgtgggctgaccacaagaaaccctatctaaggtgtgagaagaaaattaggtttcatggggaatttgctgccctcagctggcccttgtagaaataaattttattccttaattatacatttcatttttcatgtctcaggatcagattttcttacccaaactttgactaagaaactagaaatggatcaggcgaagtacaacagctgcagttagagttaggaggttaaaaattctggaagagaatgagaccaggatttactcttcaggagaagtttggagctgcttttttaaaaagcagaggttgggagagtggaggaaatgaaacaactagaatttgatggcaaaaccaatgctcttctcttgattctttttcaataaaaattaggatgaataagtaaattgctctaggctgggcattaggaattctgaggtcccttcccattgtttgtgctatctttagggacagtcccgtcagacctgacatgattagggaaggtctatggatcatcagacttctaaaccctcat

SEQ ID NO: 10815 - DNA, 1199 bp, Homo sapiens
gaagaagaagaaaaagaaagacatgggacaccataaggcaaccaaatattaaaactggggcattccagaaggcaaagagagaggcaaagtcatagaaaacctatttaacaaaataatagctggaacattcccccaagtcttacaaaagatatagacatccagatataagaagctcaaagatcctcaaatagattccacccaaaaggtcttctccaaggcacattacagtcaaaagttaaagacagagaattctacaaacagcaagagcaggccaggcatggtaagtcatacctataatcccagcactgtgggaggccaaggaagggggatcccttgagctcaagagtttaagaccgagatcgatctaagatggcgaccgtcgaaccggaaaccacccctactcctaatcccccgactacagaaaaggagaaaacggaatctaatcaggaggttgctaacccagaacactatattaaacatcccctacagaacagatgggcactctggttttttaaaaatgataaaagcaaaacttggcaagcaaacttgtggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatctaaatgttactcagatataagagaagtctcattcgcctttgtcttgtacttctgtgttctt

SEQ ID NO: 10816 - DNA, 2448 bp, Homo sapiens
cactgcctcggcccttcttgggtctcaccccagtgcccactgttggggaaaggagttcaggggtaggacctgactctcctctggtttctctgcagccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagtgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggagtgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaagaaagaaaaatagtacaaagagattttctggaaatacacatggtttgaattgtttgggattg

SEQ ID NO: 10817 - DNA, 1266 bp, Homo sapiens
gacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaactggttctgtcattgacttgatgtgtttccagaaaagctaatactggagctcacaagaatgttctggggctccctgtctgccttttttgtggctctgttaggacagtgggatatattgaagaatgcatcagctatttggccagcctgtg

SEQ ID NO: 10818 - DNA, 1169 bp, Homo sapiens
ctggactccatcctgggtgacatagtgagactctgtctcaaaaaaaaaaaaaagtgatcagattcttgtctctagagtttaatttaaatggtagtatttataggagttctttgtattgaacttaaggcagaataaggtaaatacttgaggtttaacatttgtttctgttagttttgtctctctggcacctttgcccaggtttgtagtccaagggaggtgaagcttattagaaactgggggaaaaagagatttgtggggctctcttcctattgtcctgagatggtatagaataagtctgattgtgacagaaaaggagttacttgatccggggctaaagccttgatttgtggaggtggtttcaagataatatgattaatattagtatctgaatgtactacagcagttaggtaaaagtcgtctatctgctggcaaaaaaattcctggtaacaaaagcttggcttgtgtttccttgtctttcacaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcaggttggtatttattcatgaggaattttatagttttggtgaaataaggaaaaacaagtgattgcataatcaccttttgaacaacttcaactttttgaactcaactacaaaacaaactgcagctaaatatatctttgtattccggtaacaatgctcagaaccaaaaaagctgctctctaaaatgacatttctgtttttcctctctgtagtggacctaggccatcattttcaaggcatggatgatgatgtacaaaggtattgaatgcctttgcccctagagagtagatgtcagagcaccagttaagagcaggtatcaacccctagataagggtttaggatgtaatggagaggattctatactcaggactaaatgccatctagctagtcctcagccctggaggggttagccctcttttcaatttaaacatactagaagaatgaaactcttgcccctgacatggaggatcaggtcttgctttaataggcccatggttttcaagaccagggagatt

SEQ ID NO: 10819 - DNA, 1225 bp, Homo sapiens
ttttggaggcctcgttaccttccaggtgaggggcacaacaaagcagaagactgggtggtgggaagccagcgcccactcgcaggggatccctctcaggccagttgcctctttccttatttgctagttcgacagcgcctagaaaatgcagttggtaaaaactaaaaacttctagaattagaaggcacttagaagatcacccaggaatggccccgtcgtttcttcttacagctgaactaacggaggcccatggagtgccgcaagccactcaggcagtggcagatccagaatatagaacaaatctaactcaattcaacaaatgtctattgactactttctgcgcggtggttgctgtggattcagaaattaattagatgtgatccctggcttaagggtgtcacagcccgataggagaaaacagacatgaataatcttagaaggatctagtaagttctcagcttggaggtgtatacaaggtgttgctggaaggaagtgaaggagcagttaagtctgccctggagtacaatgggagatatattggtaaaagccacagagaagagctgagttccaggatcaagccaggaaggaataagtctcacgtcaaggctttaaatatctcggtaattagactataatggtgacttttaagattcccccttcatttcagccgttttctgtgattcttgctcatttcctggcaggttacccttaagatacttggaaaactgggtggtattcttgctcatatcaatagaaatctttctcttcacagcggcttttcaggttgaaaatgtacactttttaatgtctcctaaaatgacctcagctggtgggtggtatgtatgtgtttttttgtttgtttgtttttgagacgaggttttgctcttgttgcccaggtcggagtgcgatggcgtgatgttggctcactgcaacctccgcctcccgggttcaagcgattctcctgcctcagtctctctagtagctgggattacaggcggattccatgacgcccagctaatttttgtatgtttaatagagacgggatttcaccatgttggtcagggtggtttcgaactcctgacctcaggtgatccacccgcctcggcctcccaaagtactgggattacaggcatgagccaccacgcccggccggtggtatgtatgtaaaggctcaccaaatgcaggaataatattggtgccttgaaatagggccacagtcctctttctt

SEQ ID NO: 10820 - DNA, 1194 bp, Homo sapiens
tagtaagttttctgtacacctgtgtgatttttcatgtagctctctttagtgtaaattctcatggatagaagccaaatctgtctgatttttttcatagcctagcgtggtggcatgcacacacacttttaaaaacaaagataatatttatttttttaaaaaggagtttcgctctgtctcccaggctggagtgcagtagtgcgatctcggttcaccgcagcctctgcctcttgggcgattcttctgccttagcctcccaagtagctgggattacaattgtttgccaccacaccttgctaattgttgtatttttagtagagatggggttttgccatttcggccaggctggtctcgaactcctggccttaagtgacctgcctgcctcagcctcccaaagtgttgggattacaggagccactgtgccctgtctaaaagcaaagataataaattctgatcctcctttgacttttgatttcttggcaataggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggtgagttgtcttgggttcctctgccttgaccatgatggcaataagctgtaggatctctagattttgccatagcgatggcatctgttcaggcaccttctcagtggtcctcagcagtgggatgaaggcataggaaatgacaggccacagcttaaggcggggtatagagcctgaggtatggcttgtgctgggtgccacccaaagcagctgagggcccttacccacatcctgtcatgtacatcttcttgtcttttgttcttgctgcctactgctcttcatttcctccttggaatatgaattacctctgcccacaggttttgtgtgtcccaaactagatgaaaatacagacttcattaggcacagcagagacagcatggctcaccttcatatccctagcaactagtgtggacaactgatgcccaagaagtatatgttgaatgggtacttattaatatttaatagtgatcagcctgtgacagattatgaaagtagcagagtgggtcctttggtgccttcccctct

SEQ ID NO: 10821 - DNA, 2209 bp, Homo sapiens
ctcaaactcacatctaattttttaaattatttcatatatacaataaaggtcggtgagcgatgattttcatttctcactgagggtaaagtaggaagaatggattagataggaaagcagtttataagtcaaaatatagtattttttttgataccctaatatgttgttaaacctttggcaattccttcttggcggttagttattttggaatctatgtaaaggcacttgagttgaaagtatgtaatcctttttcccattgttctccctcaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaagtctgtttcatctgggggctctcatttatatatgaaaatgatgcacacgatctgctactaatagtaaatgcacttgggatttgctttccctagcagtaaactgttgagggatgtggtttgtggctatggaatgtttttccctgtgatacaggctgtctgtaaagatcaagggagtgctcactctgaacttctctagatggtggcacaaatttgatctgcctcactttggttccagctaatcagtat

SEQ ID NO: 10822 - DNA, 1171 bp, Homo sapiens
gctctaagcagttttcttatatcaaacacacttaattctccccagcaacctatgagagaggtaatattcccattttacagatgaacaacagagaggttaagtaacttgccaaggccaaacagctcgtgaatagcaaacctgggctagaacccaggtaatgtggctccagaacccctgcttttggtcgttctgctattctatgaggtagtcattatgatccccctcatcagaaagcagaaagcatgagattcagaggggtgcaattacttgtccaaggtcacacagctcatcagggaaggagctggtacccaggcccagatgtgtgggtcacacacccagactccaggccacctcccagatctgaggccgctcctctggagtcaagtctgtgcctgggagaagcaggaaggaccactggacctgctgtcagtggggcaggcacaggctttttccagtcccaggctgccccctactggcagcaggacaaacagcaggtgcctgggcccagctaggataggaagggtgaggatgggcctaagcaggctgacacagggctgagtcctcctctccccgctccagttctctgtggacattgactcggagctggtggaggagctgccggccgaaatcgagctgtggctggtgctggtggccgtgggtgcagggctgctgctgctggggctgatcatcctcctgctgtggaaggttagtagcccagcccactcctgctccgggacctccaccagcacactcaccagcccttcctccaacccacgtctccccatcctggtcctcccttccatctcacccccacccttcctccctgtcctctccaccttctaccaccagcttacagtctcacccctggcctgggttagtggggggagctgcaagctggaaagggggacccaggagctctggcttctgaccacaccaccaagctgggactgagccccagcccccaggctccccagccctaaagccctggtccacgagtgctgctggtgaggatagcccagcgcccccctgatggcccgtccccacctcctcccctccgcagtgcggcttcttcaagcgagcccgcactcgcgccctgtatgaagctaagaggcagaaggcggagatgaagagccagccgtcagagacagagaggctgaccgacgactactga

SEQ ID NO: 10823 - DNA, 1725 bp, Homo sapiens
tctccctccaactccagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtatgcagctgcatctgcttccacccactccccagcctttaccaaccccaggtcaatggatgatgatatcatccagccaacacctaggtaggatgaagccaggtctggggacttgcgggtttgagggtaaagattgatggaggtggccaggtgcagtggctcacacctgtaatcccagcactttgggaggccaaggcatgcagatcacctgaggtcaggagttcaagaccagcctggccaacatggtgaaaccctgtgtctactaaaaatacaaaagttagctgggcgcagtggcgcatgcctataatcccagctacttgggaggctgaagtaggagaa

SEQ ID NO: 10824 - DNA, 2280 bp, Homo sapiens
cctgtgggtcctggagggaggggatgccatgtcctcaccggggggcggaaggggctgggatcatgcctggtgtccagacctgaccccctaccctcctttgttttccagatctcagaactggaaggaaacttgcaaacactgaggaattccaattctacttaacaggaatcattccatgactggacaataattaacccccctcccattgttcctccctcccctgtcctcaacaccccacccctcccccttccagcctggggacaggtgccccgactccccccacccctccaccccacctcccccagcttcagggaccagagggctcatatcacaggcccccttaagatggcctgggcagacagaggtggctagaagggcagcctctttcttgccccatggggctgaggcacagaggccgagggctgccgagggctggcctggtggtcgacggacacaagcacctgcagatcaaactgccagactttacacactccagcttttgtctctggactggaacggggctggggctctcccagcatctgccaactgggggctgctccctgcccatggggcacctgggtggcccctgggcctcttgacttgagattctaccttctcggcccttccctctccccccatcattgtgccgtctctgttgcattctgaccctcccgcctggggggtgggggcgttgcctcaacacctcccccatccctgttccctgtcctgggagggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgcctggaagcctactgacattgcagggagtcagcctcgcccccaccccctactggttttccaatgttttgactggagggcaaaattttactactactcatctttttggagaccagggctgccctgctggcagcctgccttctaagtgaaatcgactctgtttccccactttaaccccaaattggggcttggaccaagggaggtgagaccacctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctatccccagatgtgcccccatcccctgaaggagctggctgtctcagtcctgggctcgcgcacttcaccccggcagatggagggggcggaaccgggtgggcggggccgcttcgggctgcttgggccagcggccacccctgcccagccgtcgggagggccgcatctctgtatataatatatatatgtatgtattgttcccggttttgtacggaccatgccctctgtcaggtcgtccccataaaagcagcccccagagccttgctgcctggtttcttgattcactgaggtggggagtgggcagggatcaaggatgccaggctgccccagtggtcccctcccaccagtgctgcctctaaccctgaggaacttcctacagtgtccccccgtttccggttccagcaaactgcttttctgcccccattccagccatcagcacccatgctttttgtccagtcctcctgggcagggctgagggtttctagagagtttgtttagtctgcattcgtttttcagggcctctaagaagttcaaaggatgggctaaatacagcaaggtgaaccccaagtccctcccccagaaggcctttaaactgtggggacactctcaagaggcacccggtgtgaggcaggtaaaggatcaaaggattgctgggggtgggaggtgactgcctggcagtttagtacccagggtcctagaggatctgtttgccctttggggcgggccaagtggcctgaaatagccccagcccctgtgctgggccagcaggcctgtgtgctga

SEQ ID NO: 10825 - DNA, 1205 bp, Homo sapiens
cctgtctgtgccttcaccccttgcctctcccctcaccgcatccccgccttccctcctgtcagcgcatctctccaatctgactccttttcttctagggagaccgtggtgagcctggtccccccggccctgctggctttgctggcccccctgtgagtaccaagacccccatcatttttcatcaccgactgggacctgggacctcgagggacggaatgaggacaaaggcgtcagccatcctcaggggagaagggtggagacgggattgtttcccacccaagcatcttcctgcctccattactgctcctcccccaggtagtggaaactcctgcctccttccctccattcaccgccctgcttcctcccccagggtgctgacggccaacctggtgctaaaggcgaacctggtgatgctggtgctaaaggcgatgctggtccccctggccctgccggacccgctggaccccctggccccattgtgagtggcttggccctctgtgcccacgaggctggtgggctgggacccaggacgggtccaggcttgatgcctctgtgctctcctacagggtaatgttggtgctcctggagccaaaggtgctcgcggcagcgctggtccccctgtgagtatcacccgcctctctgttgagcctctcccctctccccaggcagcggtggcaggtgagggcagctgggtcggatgagttggctgttctccctctgactgttcctatgttctctccttccagggtgctactggtttccctggtgctgctggccgagtcggtcctcctggcccctctgtaagtctctgcagcagagtccactgctctaggttgggggtgctgggtgggggctgccagaaggatggtggggctgactgaggacccaatgatgcaccagagccccctggagtctgacagcccctcctatcctcatccagggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctgtaagtgccagctcagatctctgcagctccggaggtgtgcagagctggggaggggtccctgtgctgctctctggcacctcacccctgtttgcctcccaaagggtgc

SEQ ID NO: 10826 - DNA, 1156 bp, Homo sapiens
ccggatctgcgtctgcgacaacggcaaggtgttgtgcgatgacgtgatctgtgacgagaccaagaactgccccggcgccgaagtccccgagggcgagtgctgtcccgtctgccccgacggctcaggtgcggctgcgctcggggcctggggcctggggcctggggcctggggcctggggctggggctgggggtggtcggcgctcgctggccctccgtgctggaggcctctgccgacgggagcagcattagcaaaccttggctctaacgcgcgtctcttcgtcccctagagtcacccaccgaccaagaaaccaccggcgtcgaggtaatctcctgccctcgaattttgcccctgcgcggcccgtgactcctcacagtcctcccttctctaacctggcctcttgtttcttctcccccaatcccacagggacccaagggagacactggcccccgaggcccaagggtaagcgttgcactctgggctgtggggggctgcaggtgggcatggctctcggccccacgctcaccccggccccgccctctccccctgcagggacccgcaggcccccctggccgagatggcatccctggacagcctggacttcccggaccccccggaccccccggacctcccggaccccctggcctcggaggagtaagtggagaggccttgtgtgtccactctcccctgttttgtttttgttttttggcagatgacataattttatactttgaaataatttcaaacttacagaaaagttgcaagaatcctacaggaaactctcacatacccttcacagtttgtgacatgtgctttattagtctctgtttatgtatatgtatctttttttttctgaactgtttgagcaagttgctaacatcaggctcttttgcgcctaaatacttaggtgtgtttttcctaaaaacaagagcattctcttaactgacctacacaatgattaaattcactctctaatgtgcagtccgtattcaaagttcaccgatgtcccgataatgtcctttatagattccaccccccaccaccccaatctgggatccagtccaggattatgtattgcgtttaatcatcatgtctctagtttccacaaatgtagaacgttcctcagactttctttgtctttagtggcactgggagttt

SEQ ID NO: 10827 - DNA, 1225 bp, Homo sapiens
atgatggagggaggcccagtgcgccctcagtggctggccagggaggtgctcccatggtggtactgattgtgcggagtccttaggtgaaaagcgcttctctgggtaaaaggtgggcaggaacatctaggtctgagggtgcccccaaccaagatggaactcaaggaacaggaggaggtgagggtctgccccagtgatgtgtctgcatctctcttacagaaaggaaggcagaggaagccacggccactggaccctggcgagggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacccccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactggtgagggacaggggtgctccagcccttcccaggcgggggcaggggggtggcatggcccggatcctcacccctatctctctgaggaagaaagagccaaggggatcctacctccctgcctaagtcttcatccagtgtacttactaagtggcagaggcagagtggggacccacgagcatggagctccaagtctaggtttcttcggaaggcaggcagctccctcttcccatctcacccccaccctgtgacctagggtgggcctcgccaacgcctgtcctctgctctcagggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaaggtactgtggtggggagaggccaaggggtctgggatgagcagagcagaaacagaag

SEQ ID NO: 10828 - DNA, 1222 bp, Homo sapiens
acatggggcaccttcaacagaggcaatcccagccatggcctggtcgttatgattggagctttttcttttcggggcaggagcagcagcagcctaggtccctcgtcactgtcctaggactcatgttgaaaagggttgtccatcctccctccctttcccaagcctcctctccccctcccactctcctaccattgacagccggagctcggtatcagtccttcacagcttgcttaatgtgggagcaagggtgaaggtttctagacctctaaagtcaccctatcagccagccacactgagctcagcttggggaacaaattcctgcccaggctgccacatgtcaagttctcctagttgccaggagggggcactcctgacaaccaaccgataacagcactggggtttttgtcagctgccgtggtgctaaccatgcctgtagtatctcaatccttacaactcttggagggaggcatttttattatcatcatttagcagatcagaaaactgaggcttagagctgtgaaatgacgagcccaaagtcacagctaactatttgatggtggcagcagccttcagaaagaggcaggaagcctccagagccactcagtcactacactctccggctcgcataagagcctggctgggcaggtaagcaggaaggagctaatggcaagaattcgaaggaaaaggtacttaggttcagaggctaagataattcgttttttctggctcctgttttagtgaacatctgaagctgtaccctggttctccagaatgttgtggtttttgtttcccaatatcaactctcaggtcaataaggaggaaaaattaacaactaggttcagcatattaggcacaggcagtaaatattagaacacttagactctgctggccaagagctcacaaactagcctgtgggtttaacctgggctatggctgtgctgtgttaggctagcacaacggttttcaaagtagtagtagtatttttagagacagggtctggctctgttgtccaggcacgatcacgatcatagctcactgcagccttgacctcctgagcgcaagtgatcctcctaagtagctagggtcacagatgtgcacgaccatgcctggcatgcatgcattctttatttatttatttatttatttatttattttatttatttatttattggcagaacaggggtctctccatgttgcccaggctggtctcaaactcctggcctca

SEQ ID NO: 10829 - DNA, 2485 bp, Homo sapiens
gccagttgcaaatctacccccttcagatccaagggaaaagttgtttctgtttcggtctgtggagacattttttctcttcagggcctggggagtttttgcttgaggaaggaatgtaggtagatctgcacggaggagactagcagagattagtatagagcaggtctcctctgactgaacttgctttgtctactgttacttttcctccagaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtcctccagaccgactctcagcagtgagcttgtccccagcacctgctgcctcccagccttggagtttggattcctatggaattgggttctgctggacacaacctctttttagcatcagacctacctgccatcatcaaatggctgcagattggtacatgagacctcctctttgtaggacttcttcattccttagtcagggttccctgaaggaatgaggagaaatgggaggtggcgggggggcgtggggggcagttacctgcatgcctaaaggagtaggcttgggggtggggagagagaaaacatagccttttctagttgttatataaagctgtgtaaaggcaaggctcgtttctactaaatggtcagctgtcactacatttatacttttgtatgccacaaaccctttcattcctccctgggaatcagggtagatcaggaggaactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacaaacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattggaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtggactgtctttgttcctttgtgttttgagggctggctgggtaggagtgggggtggtttgtctgtggcagtgaatttttgccaggagaggaacattaaatgccaaaggtaggtggcagtatttcagtctctgccccagccgacaggcagagagaccttcacaaataataagacccaagaaagactgggcctcacctaggcttgtgttccaggaggtgctgccagtctcttcattacagtcaggctctgaggttggggaagtggaagtttccagcttttcatcct

SEQ ID NO: 10830 - DNA, 1027 bp, Homo sapiens
ttctcttctcacttgtccccccataccacattcatttctgaagcttgggaagataggagtcccatagaaaactgccatggttttttctcttcatagctgagttctagaaggcaatcagttgctatgccttctgagttagtacctaattctagaggagcaccacttatccctcatgcctttcttaggtcctccttgttattttaccctaatttctctgctgcttgaggataggaacctcgtaatcagaaaccattcagcaaaccctgagagcagctgcttttggggagggctacttccaggagcagaaggatggctgtttcctttgaatatttcttatgtgaaccatggcaccagggtaaaggtggcagaatctgtacttttaatcacttgggaaagcaaactgctggagtgtttgtgagagagaagtcaaattttggtatgttttgttgtagaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgagtaagttttctgcctgttgtaagattccagcaggggtacagtggagacactcatgtttccaggcatagacaactggggtgagcaggcctgcaaaccttagataaagtacactctaaagcttgggagtggatgagaaggtttggttacggggaatgggggactctcctagggaggcagtgcccagcttgtttgtttctccagtgcccacatacttctgtgcaggtgtttgggtcagatgtatcttgaagcattcccagaacagagtctcacttttttttagaggtgagggtctaaaatcattgagatatgcaaaaatcacacacatggtcaagtttcctttttttttttttttgagacagagtttcactcttgttgcccaggctggagtgcaatggcgtgat

SEQ ID NO: 10831 - DNA, 2525 bp, Homo sapiens
tggggaaagcacagatactggacagatggattctagtgtgacttgtgactgtgaggtttcctataacatatttataaatgttactcaggttaaaagtatttaagaatacagttaactaattgtaaatatgctgttaaccaaaagagctttccctccctcactttttcctttgtaaacactcatgactgcttctctgtctcgagtcatctctgcattaactccccttcgtggtcactagagggctctctgatgccttctaaaagaacaactgcttttttacaatgccccccacccccaccccgcccatagagacagggtctcactatgtggcccaggctggtctcaaacttctggccttaagtgatgctcctgtccttggcctcccaaagtgctgggattacaggtgtgagccactgcacccagcccactttttttttactctgaagtgattccagtcatatgtgtgtgtaactgcatcctatgagaagagcacaaatattgctgttccatgttctccactttcattttccactacaaatgaaaagcaatttttgagactgaatctgttgctattttaaaggttattgtgggaaactgagctaaaggagttagcatctttatttttgtatcaaaaataaaggttattttgaaattattaggatttttacacaattctgaaatctgttgcttttgtaaacaaattgtttgatcttagtgatccccctactactaccaccaattcacttcacaaagtcagttatgagtctaccagactttgttctgaaaaatagaaacaaaacacctgattaagctcttgagtatggcataggaattttttagaagaatgcattcaaggattcttttcctttccttcagtgtcattaatgttaaaagagcagccactgttttgttgaaacaaacagcttaacttcagaaataagaactagcacacttagacaaacaggagagcaggggtttgaagccagctgtcgaagagcatccctgctgtcttaagaagctttttccccatagtgcctatagtttccaaagaaactcaacttcctaactgtgttaacttaattttattagaacactacagttgagtgagaacgtgcagaagatgtcaacagaagagaatgttgtgctaagataatggcctcctgctgctgcctaaatgctgaaatgaggttgagatgtttttcaaggctaacttcatggactcactctgtttagtgacttaattgtatcccaccaattactgctggtgacttactcacccttgtacagtgtttgcatagcagagtgaaggttacttattaccctctttctctcaagtgctttaaagaagaaacctccctggtgtttcttttctttttttttttgagacggagtcttgctttgttgcccaggctgaagtgcagtggcataatctcagctcactgaaacctctgcctcccgggttcaaacgattctcctgcctcagcctcccaagtagctgggattacaagcatgtgccaccatgcccagctaatttctgtattttagtagagacaaggtttcaccatgttggccaggctggtctcgaactcctggcctcaagtgatccacctgccttggcctcccaaagtgctccgattacaggtgtgagccacccggcccagcccctcccttgtgtttcaaccaatcggaagtgaatttaactagatgtagtaaccttttttttctttacttctaaaacagttacagtttactaataaagttaagtctggttctgtcctagaggaaataaattcactattaattcatgtcttaagttacttgggttaaaacactttcagccacccagattaattaaagtggagcagtggagcccctggctgggagatggcctccagaggagcagctgcagggcatgttctgggcttagcgacagaggcaagcaagggactggtgtctctggtgagaggtgggtttgatgtatctctgtcctatgctggtctctcttctcctttataaaatcctctgtggtcaactgactactgcgtatcgcagtggaataagactgcacagttgctggtaggtgagtttaaagtcttaatctatgcattcagagaaatatttttatatgctttgtgtaatttataacaaggattttttttttagctttgttaactgtgaattcacccctcctcctccactgcatatttaaagcatgtgttcacactgtgtgtaaacattcactgaagattttttctttgtgcattgctgactgttcaaacataacaagtattattaaaattaaatattaactgaccgatcctatatgccttcattttggcttcctaaacagcactacagttctaatcatagggggttcaaattgttggacagtcccagagaccagaagctctgcaggaaaattagaagggccctctctccacctgagcctcctccacatcccgttcataccctgtcagtagcacctggggacggatattttgtgcggcgtctttccttccagttca

SEQ ID NO: 10832 - DNA, 1195 bp, Homo sapiens
tagcttttattagtagcttgtcatttggctcttttactgtcttttttgcaaggagtttcatattttacagatacctttaggtccataattgttaaatctttttagggtaactcacatcctgcccatgccttctttccaaccttcttccctcttcccctgttcatgtatagtttgatacccaaacctgttcttaagactttgcctccttagctccaatggcagaagtaaattatccttctacatagctggaatggtttcccctgccttgctcttactttgtgaaccatagccttagaagtacggacgacagtgcaggaaactgccccagcagaggcagagctgggcctgagcaaaccctgctggctgcacttggttttcccaccaaacaggtctgttaatcatgcacagacctttggcatgattaagtataaccatcttctggaaaagatcttaaacaacatgggctgtgctgtgccagaactattcattaacatttctccttttttttctagagctggtactcaaggtgagaattcagaacccatctcttcgagaaaatgatttcattgaaattgaactggaccgacaggagctcacctaccaagagttgctcagagtgtgttgctgtgagctgggtgttaatccagatcaagtggagaagatcagaaagttacccaatactctgttaaggaaggtaagaaaagtctaagcatgaatggctgctttttgcatttgaaaaatacctagccccctccttggttatatgaggtagttgagggaataaacaaagaatagaaaaggagcaaagagtgattttccaaatgtaatcatttccttctactgagtctatagggacactggctttttttttttttttggcaagtcaagtgaagcagtggagtggagaaggaacaaagacatctgtaactggtgtttggccagttacagtcttacaaactagttgtaaacaccattgcattcagaccagccacactggcatttttggaagttgataccagagagaagtttctgaattatcattcacgtgttcctattttcggtttctgtagtgagctgtgaggattaacttagtgcactactagatgtgccttctgttttacaagtgaaggaccaagttcagttacagagcaaatcacatagatgcatgtgtggtccttcatacatctctgggttt

SEQ ID NO: 10833 - DNA, 1109 bp, Homo sapiens
ctttaagtgataggatgggttgcgagagcggaatcagtgaataaaatagttccatcttcggggcaacttctgtgccatttcccacctgtctaggaaatttcacccaacctttttacaaagttagagtacctgatggtctcttaagtgcttgtctcactgattccgagaaataaaatatgaaatcagccatactgttttaattataattacaaattgaagaagagtcttaaagagcacaacgataaccatcttagcactattggagatgaatttagaaagattttcaataatttttagttcttaagatttctaatgtaaatatgttttagagggtaagttttgcctagtcttgttaattaatagcatctactccaaggcctttacttattgtaatactggctgaagttgccttttggttttaaattattaagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaaggttagtttatatgagaattcagttcattaagaaacttttcacaccctaatcgccccactcacttttctccagacacaggcaaagatccatttcatacatactccttttcactttgaggaatgccattcagtaggagacaggcattctttccccctctcctacttagatttgtgaaaatgacagtttatctggtgttttcttagatgttaaaaacatctttcagttgataaacctgaaggtttttaatgtagcttcttttaagtgttatattacctttcggggttattaggtgtaggatttattatattaccttggttattggctccttttttttttacacactgcagtgtttcataatacgtcttataaagtgagtgtacattgttgcattaatcttcatttgtagcattcatttaagttagtaattaacatctaagtacctagaagttgaattgcttacatgtgtcttacccacgttttcaatgggatcaacatgctctttcccctttactttttc

SEQ ID NO: 10834 - DNA, 1908 bp, Homo sapiens
agcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacg

SEQ ID NO: 10835 - DNA, 1719 bp, Homo sapiens
tttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataact

SEQ ID NO: 10836 - DNA, 1328 bp, Homo sapiens
tgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccc

SEQ ID NO: 10837 - DNA, 1341 bp, Homo sapiens
gcagactccaagcctgggaccatccgtggagacttctgcatacaagttggcaggtgagattttggtatttttcccccttttccaaaatctgatttagttgccacaaggatttgggtttccgaggctggaggtagacatgataccatatgcaggttgattttatcggagtttattgttttcctccctcttaagttggcgtttggctttggttgttaacatcacttagtcgtacctctgttacacgaagtgtagaacctggtacaacacactttgctggccagtctttcctgaaggctctcactgtttgcaccagcgtggccgggagggctggatgtggggagggcatttttcagccttaagtgaatggccattgtaggctttttcttttaacatggtctaatgtccatggagcttcagcttttatgctgctgtggctgtagatttctggcaatgggcgcattttaatccttctggtcttggtcatgtgactatctctttctccacccaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttcttttcatgtacactgaataacctgacctaatagagagtgtaaatactataaaaatgatttattttgaggtctcacatacacacaggcattctttgcctgcccttcttaacccccgcatcccttccactcttggcactgagctattcaacaggcatctatggagcatgtgctacgtggccaagactggactaggtgcagaggattcatcagaaatgaaagaaaacatgagggctgggtgtgctggcttgtgcttgtgataccagctacttgggaggctgagatgggagaccagcctgggtaacatagcaagaccctgtctcactaaaaaaaaaaaaagaaaaattaggctgggtacgatggctcatgcctttaatcccagctattcaggaggctgaggaggagaatcgctagaggccagaagttcaagtccagggtgggcaacatagcaagacgctgtctttacaaaaaaaaa

SEQ ID NO: 10838 - DNA, 1341 bp, Homo sapiens; identical to SEQ ID NO: 10837

SEQ ID NO: 10839 - DNA, 3231 bp, Homo sapiens
cttttttggtaacattaaagtttaggtagcaggattgaaggaaatgatttaagaaggatatagctgttaaatgcaaatgaactgtcattacaaatgaacctttttggtacctgttgggagattttgggatttttagaagttaggccagtcacatctccagcttcttttgctgcagaaatatgcaactgaactcctcatggaggggtcatcaccacaaaggtcatggaagggtcattatttctcttgttggcattttattgcagcccattttaaatgtttgtacagaaatatttttcattctgtgaaaatttatttggagttctgtatgaaactggaagaactctggatacttttatatgttctcttttaattaaaaaaatgattagaattatcctaacactaaagtgttaaactggaatggttgacaagatattcaggatctcagtctacacattgaggggttggggaaaatgtaatgttgtccttagtttattttcctttctaaaaaaaataccccacgaaagggattctgatcagttctctgccatttccctctatctgtgaaataacagcttcgtataaccacaaccaaaaacagatgttctgtattaggagaatcgaattgaaagttattcaaagccaaaataagtttagatttcaaaatcattccagctctgcttttatctatcctggatttggtagaaaactaatttgaaagagaatttaattttcttaaaattccatatatatatatatatatatatatatatatatatatatatatatatatatataaaattgtctttaattgtattcaggatttattttaataataaccgatttggaccattttgaacattccctgttttaaaattcatatgacttccttttaaaaaaaaaaaaaggatacaagggtaaactggtgaaaggtttgctctctgcattttctaactttctactgagttgtgactgaatgagagcgctctagcgtttaccagtgaggttcataaactaaactctcaggaattaattgcatctgttctagaagtgcttctgggtcttagcctggcctcttcagagtggtaatattgaccatctcctctggaatataggtagggctaattagaaattaatcaaaatgattaacctctacagtccttcagcctatggaatgctttaaaaaatgttaatggaaagccccaggagaccattttaggtaagacttttgtttgaattttaaaatgcatagaacgttaaaaaaaaccagcaatttattttctaaaatattgctctacttttgggaataatagcattggtaatacgcacaggtttacctcattctatgcaagaggggttaataacataaggttttataatagctactggaagtaaaatttgttactttatagtgtaagaatgtatggaatcgcatgtcaccatttcttaatactgactctttaggggcataaatgcagatcacatcaacgcaagttgattctcatgtgtcaaatatatgtgaattcagctgttaaattactggatatttatcttaacattgctgagagggacctactgtaaatgtgacatcctcacacttcccatatctttaactttgaaaaatcttcttgtaaacttaaagcctagaagtattccaaagcaagggttagagcagtctttattctcaggctcactgaattaaacccaggactaattccacagcacaggcacaagaagcctgttgtgtagtgtactctgccagtaccttggatttaggagctccatggggaactgactaaaccaggagagagaggatttggagctagtcagtcctggtaatctatgaaatgctcatttatacccaggtttcataagcttccaattctatagcaaacccaggctctgagtgttttagaatttcctaattcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggtttgtttttgttttgttttgtttttcctgttaggatttatttggggacttttggtagtttaaactctttaaccttttccttgccgtgtatgaggaaagctaaagctgttatcaacttcttattctacgatactaacacgggttttcagtgtttgtttgtttttattattattattaattttgcgtgatgtgaataccctctcccatcaatatttgtattatggtgctatatattggtaatgatcctttaatattgggaagggattttaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatatatagatcaatatctgtacaaatttaatcttttattttcttggtaactcgtgatcattgagaaagtgtttgaaactttctcatgaagtgtatatataatggcgtgaaaaattcctttggaaaaatttatgttcctttcatttttaccaaattgcaaattttcagcatggatgtgaaaagcattaaaattataactttgtgtacaagatgaaaataattcactaaatttgcccttttttacacaaaataaaatgttaaagttaagctggatttgagcagttctttaatatgctttggtttggggggttgcttttctattgcgtgccctctataagcagtcagagacccctatgaaagttggatcagccccttcctcttacaaggggtagcaggcacatgagtgctgtaaggaagaattttccactagctgccaagggagccaagagtagtatggttagacatatggatgaggttgcattggaggtgggatttcatgggcagggagggaaagggcaaaaaccacagcaggagccaaggtgaatagggacctttatggggaaattaaatcatcttagctagaacatcgtgttttggggttggcatgcttagtaggagacttttttttttttttttttttttg

SEQ ID NO: 10840 - DNA, 2204 bp, Homo sapiens
ataatcccagctacttaggaggctgaggtaggagaatcgcttgaacccaggaggccaaggttgtagtaaggcaagattgcaccactgcactccagcctaggcaacagagcaagactccatctcaaaaaagaaaagaaaaagaaattatgggtacaattgaaatacatgtaaggatgccatgctctgaaaacagttgaactgtttgcactgaacagatggttctcaaagtttggttcatagaccagcagcaacagcatcacctgaggacttgttaaaaaggcatattctcagttcccacccaagatctacaaaatcagaatctctggagtgagacccagccatctgtctgttaacaaaccctgcaggtgattgtattgcagatagacactagtttgacaactgctatcagatgctgtattgttttatttaattttattttcttattatgtagtgatttatttctgggtttcaggttacaatgcccttttaagatatgaaggatttgaaaatgactctggtctggacttctggtgcaatatatgtggttctgatatccatccagttggttggtgtgcagccagcggaaaacctcttgttcctcctagaagtaagtagtttatttacccttaccgtaatttttttatatgtgtactttaatgctattttacacatagtaatgttagagtaatatggaaattaaaggccgggcatggccgctcacacctgtaatcccagcactttgggaggccaaggcagtcggatcacttgaggtcaggagtttgagaccagcctgaccaacatggcaaaaccccatctcaacttctccctagctgggcatggtggtgcatgcctgtactcaggaggctgaggcagaagaatcgcttgaaccggggagatggaggttgcagtgagccaagatcacgccactgcactccagcctgggcaacagagcgagactccatctcaaaaaaaaagaaagaaattaaaatagtttttttggtgttaagcagctttttgctggcaaggcatatacttgctttctctatatttgttacttttcagaatgttaatagcctgactttgcaaggaaatttgttacttttttaacaaataatttatgaagcagttcttttttgctaaagtataactgattatttcttctattttagctattcagcataaatatacaaactggaaagcttttctagtgaaacgacttactggtgccaaaacactgcctcctgatttctcccaaaaggtaaaaaacaggatcttataaagactgaagagctctaaaaaacaagggtaacagagaacatttttaaggaattggtttaattttgtgaaccagatgatctgtgttacatttcaagtgcattcagtattttttacagtataatacaaaaatttcttgtagacctttgtcatgaatttcgagcagttttttttgtatgcttttaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctggtaagcacctatcacaagaactcctgtcaaaagcatcattgaggctgattatactagttggttatttttctctgcagaattgcatagatgaaaaatagcattctagttgtttgggctgcttcttctaccttaattagtgaaggttcacaccatattagtgtcctaataaatttttttatattccttccacttgttctccaaaagaaggaacttcttctggtcacaactataattgtttctttcttttattattcagcccatttgaaagatctaaagatacctttccctttccattcaattttaatcaaaatagcaagattaaatgtggttagacttaatactaagcacatgaaaacatgcttctaaagttgtaattttctaactagggaattacattaaaattatgagcattaaaattggctgaatgtatttaaaagcatatatgcacatgtactctgaagagagaaaagactattaaagaatattcaccccaaatgtagaaggcat

SEQ ID NO: 10841 - DNA, 1208 bp, Homo sapiens
ccataattaaaaagaaaaaagaaatctgggcgaggcacactggctcacgcctgtcatcccagtgctttgggatgcagaggcaggacatcccttgaggcagggaggtggctcacatccataatccgagcactctgggaggcttgagtgggcagattgcttgagacgaggaattaaagaccagcctgggcaacatggcagaaccccatctctacaaaaaaaaaaacacaaaaatgtttatgggatggtggcacttgcctgtagtcccagctactcaggaggccaaggtgggaggatcatctgagtgcgggaggtggaggttgcagtgaccgaagattgtcactgcactccagcctgggtgacagagcgagactctgtctcaaagcattttttaaaaaaagaaaaaaaaaagaaagaaaatggttatttctcagggctgcgttttcatttatcaaatctcatttaccagaatttgtgctagggtcttttagggggtgtgtatgagtgttgtgtcatgtgtcactggtttctcttacttcaaagactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatgggtgagtatttataaccttcacctgttctacagctttatgtttaagggtgtgttttcatttggtttcttctgtcatttccccttccttagaattattaaggggcagtttgaagagctgacgtttataattcgagataagatcactgagttggtgtttaactctttattttgcctacctcctggtggaaagcaaatacaacaacaacaaaaaaaggccagtgagaaacttcatgtggatataaatttagtaattagataagaaatgcctctgtaactgaaagtataagtgcataggatcatgggcttataaaattgaaagagacattcgaggttgggctccctcctctatattaatttcttataatttccgttttaacataactggtgcttggatattctctgactcagtaaggaatttctctctgcctaaaatctggcttgaaaaagaaaaaggaaatgaaaaagga

SEQ ID NO: 10842 - DNA, 1189 bp, Homo sapiens
atatttcttgtttattcgtttacatcaatatagactcatgacttcaaattttaatcaatttattactattattttttaattctgatttcaaattttcttagacttagccaatagaagcccctttatgacatgtttccatcattctttcatcacttccttattttctggcactacaatgtgccatgcttatcttgtattttcctgacctgccttggaatcagccttctctgccacgaattttggtttctttagtggaaagtggcatttagaaaaaactctgagcactagaagtgttcattactagcctctctcagcagagaccctagaaaatttttgtgtataaacaagtgtgcatatgtgtgttcaacagcaggaaatctggctacctttatcttcagtgtatgtacttacttgctcaattccccccatatgtaagcaaattactgtggctgaaagcttggccctagaaaagtgaattcatctctgcctggtatgtcagcccaaagctgagtattaaatatgctgcccactggacaccatccaaacactcagcaagacaaaagtgacgaggaagaaagaaagagaaaagtgtatttaggaagttcagctccagacattttagaaagggtaggaggaaggaggaaaggccagttaggaagtttggttctagacacataggccctttcacctacccttttcccaagctcagcgcatggataggggaagcaggcttagaatgatgagttaacttgtccaagcctaatcggttgggtagtggcagagctggagtttaagcctggattttttctgactccttacaacttgctatttttactgcgtcttgtagaaagcagctttgcaacggatgacaacaaaacaacaacaaaaacactgaagcctttcttttctatattaggaaatatttctttacttttgtctcaggtaaaaatcatcattaacgtggttagatgcctatttgtaagatggcatatttgaagttatttctaagctagaacaaacagcttagacagagttgagcatagtaggattggggtcagagaccgaggttataacctggatacaaggagttcttatgatgatgaaaggtctgtcaatatgcatagatacaataacaatacaacattgggagatgctgaaatgaatatttttttctctaaagctttaaatg

SEQ ID NO: 10843 - DNA, 1207 bp, Homo sapiens
tttttagtttactatttgtgtaagcctgcccctaacaagccaaaaattagaagattttatgttgaacctaattcctatcaacttcagttctgctctcaaaggcaagatgttaaccaaatataattcatgttttagagtgtcacttgtaaatctgatgtagtaggattcttttgccattttacatgtgccaaatcatataaactaagaaatagtttgatttttggttctaggacaatgtcataaatttggtattagctaaagtgctagtcttggggaaaaaatgaggtagtagtaaaatcaggaagctaatcttcaataggcacttaatccataaagagctgacttcccttgggtgtttaatcctggtcgactgtttctggtattgattattttccctgggttgtaaagtttgtaatgaaaagttttattctttggagatttgaaaaattgcttttcatgagtcctttatcttccaggctctaaattatcttggtattcagcccacaaaggaacaacaccaagccctgagacagcaagtacaagcagactcaaaagggacagtgtcttttggaggtaatattaggtttattgtgttgtattatcactgaatcatcattcaagagttatggtgacacattttcattaagagtgtttgttctttagaaggagagaatgaaaagtaaaactacatccatttcaaggtccttaatcagtacccaaagaactcagctagaattactgacctggcagggtcagcagaaagaagaatttcattaggacctttcagctctaaaatatcatcattctgtcatattctttttattttttatttattgcataaacattgctttagtaataacaaaagaaacagtacaaaatatggaagttctaatttcactactgtgagattaattcgaatcctttttcagctaatataatatagtaaatatttttatgatgctacctaattagagtcatcccttggtatgggaggggaattgtttcccggacccctgcatatacccaaatccagccatactcaatctcatagacagccttgcagaacccacatatagtaaaagtttaccctccacatatgtggcttttccaacctgcaaatactgtattttttatgcatttggttgaaaaaacttgatgtataagtgaacctgtgtagttcaagcctatgttgttcaggggtcaactc

SEQ ID NO: 10844 - DNA, 1133 bp, Homo sapiens
gggcttagcaagaatccttttccagtgcaaatacgaccctcatattatgttttggcgagtagccagtctttctttaacatcaatcaaccgtagcaatgtggtcatcacgaagtcttcattgactcactggcttggattttagggttagaaaatctgaatgttcttatgtccttccgtctcactttactagagtgcccaagttgactcatccttactcactcattccctcaaaatatttattgagcaccaacaatgtcacaagcactgtgctaaacactgtggtgaagtagaacaattgctaatcatttcctgggttccacttactcttgatttaaaaaaaaaaaaacaacaaaagagtttgtgtgtggccaggactaaacagctgcttcttaatttttgaattttaaaactaatctattttatttaaaaaaaatcaagtactttggaagtgaataaagtaagagatagcctgtctcactttccagaggtagcagtcactaatactgtggtgagtgattttactcaaaggaaatcacactattaagcagcttggttttgacatgttatgttgtggtcatcttttcatgtcaatacatagattaatcttttatttcaaatgtctacataaaatatcactacccacataacctataatttgtgtggccagcaatttattgaacactaaaatgttttaagttttcttattgctaacaatgtcacagtgaacatttatatattcattaaatccttttcctcatgtatctttgcactcttgtgctagtatgtctatagtgtgaatacattcataaatttcttgatcaaagctaggtcaaagttacattcattttaattttggtacatatccataaattctccataaaagtaggaccaacttacattaccaccaatagtgtatgtgagccttatttttatgtatgataggactttttttagtccaaatgttcctatagattttctgggttttttttttttttttgtccttggaagaataaccttccttccaccaagtccaagaacctgagatttttaatcattaggttttagatttcctttagcagcagagactgacttgctgtatagagggaagtcaagtagtgactaactcactatat

SEQ ID NO: 10845 - DNA, 1571 bp, Homo sapiens
gctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgtttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctac

SEQ ID NO: 10846 - DNA, 1174 bp, Homo sapiens
cctctgcctcccaggttcaagtgattctcctacctcagcctcccgagtagctaggatcacaagcacacaacaccacactggctaatttttgtatttttagtaaagacaggatttcaccatgttggccaggctggtctcgaactcctgacgtcaagtgatccacccgccttggcctcccaaagtgctgggattataggcatgagttaccacacctagccttgtatttcagcacttaattacctggacaatcacaggcaagtgatttaaccttcctgcacctcagtttccagcccaatagaatgaggctaactcttgctttgtaaagtcagtgtggggatgagctacaatgaatataaagagtctggcagggtgcctggcatattgttaaatacatagtagccagtaatgttatttaactgtatctctactcatctagagggaaatcatcattacagatgaaggaaaatgttggataaaaataatttgtctttttcttttgtttctaggtttttgatgtaactaaaactcctcctatcaaagccctacaactctgtactcttctcccatattattcagctcgagtacttgtttgtggaggggatgggactgtagggtgggtcctggatgcagttgatgacatgaagattaaggtattagtctttaagaactactacagaaggacttctaagataaatatactatacatatatatatatatatgggttttgttgttgttttgttgttgttgttgttttttcttgagatacagtctcgcactgtcacccaggctggagtgcagcggcgcagacacagctaactgcaacctccatttctcaggttcaagccatcctcccacctcagcctacaaagttgctgagactataggtgtgcgctaccatgcctggctaatttttgtattttttgtagagacagggtttcaccatgttgcctgggctgctgtcaaactcctgggctcaagcgatcctcccaccttggcctcccaaagtgctgggattacatgggtgagccactatgcccaacctaatatagaatatttttgctttatattttttattatgcagatgaatattagacattgccagcttcaaatagttaaaaatgagatgttttgattaagcaattagcacaagctttagcaaaacaacatacagtt

SEQ ID NO: 10847 - DNA, 3068 bp, Homo sapiens
cccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcctgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggta

SEQ ID NO: 10848 - DNA, 1810 bp, Homo sapiens
caacctccacctactgggttcaagcgattctcctgactcagccttccgagtagctgggactacaggcatgcgtcaccatgcccggctaatttttgtatttttgcagagacacaggttggccaggctggtcttgaactcctgactttagatgatccgactgccttggcctcccagagtgctaggattataggcgtgagctaccatgcctggcctctttttttttgttttgttttttaattaaaaaaaataatagagatggggtctcactaggtttcccaggctgatcttgaactcctgggctcaagcatttctccccctcggccttccaaattgctgggattacaggtgtgagccacagcgcctggcctaaagagttactatactgcaattgaactcagtttattggaacccaaattattcccgttcttcaatcattctacacagacggaaaatttacgtggctgaattaaccggtatgacctcaaaatgaagtgcctaaactgggtattttgtctttttcctcagatcactgtattttggaaagagttgattgacccaagactgattattgaatctccaagtaacacatcaagtacagaacctgcctgagtatgacctctccaccttatagtttatgaatgtcttgtttgtgaaagtgactataacccaaacttttttttttttttaaagaggatttggaagttgtatggatttttttgttatcttcactttactgcataggaaacaatctacctcatcatttaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaggaatcctttcacgtttttcccaactttaaaattaaggattctcaggtccctgtgtagagcagtgaaaataagatgtgcgtatgtgtgtgtatgcctggagaattggtgtttcacttcagtgagaggattggctgtgagcttcagaccaggaaatgtgtcatcttgccaggcacctggctgagtgtgctggagtgaggatcttgaacagaaacttccttttctgttattattcactacgaagctaaaatggccaaatatataccgtgaaaattggtttcatttaacaaaagatcagatccctccttcagctgtacacatttttaaataaaatcatattgaactaaacatctctaccgagttatcatgttgagtattgcaaattattgtcttattttacaataacgtgagagattacaattttctgtaataagaaggtttgctttgactgatgagtctgatgttgcaaagtttggttcagtggagttcatctgatctgggagccactgtgccagtggagatgctggccagttttactttgcatgacatgaatgtgtttcaaaatgtgcatttattgatttgtaatgagaagtattactcccgaaaggatgagagtaatgtgaacggtgggatcttggcactggggttctgtgtagcacagttgccttccagggttt

SEQ ID NO: 10849 - DNA, 1206 bp, Homo sapiens
aggtagtgtaagcgtttgctcaaaagagagtcccagttcctcctcggagtctgaatcttgtgatgaatctatcagtgatggtcccagcaaagtcactttggaggccagaaattcctcagagaaattaccaactgagttatcaaaggaagaaccctctaccaaaaatacaactgcagacaaactggctataaaacttggctttagccttacccccagcaagggcaagacctctggaacaacatcttccagttcagactctagtgcagagtcagacgaccaatgcttgatgtcatcgagcaccccggagtgtgctgcgggtttcttaaagacagtaggcctttttgcaggaagaggtcgtccaggcccagggctgtcatcacagactgcaggtgctgctggatggaggcgttctggctcaaatggtggtggacaggctcctggtgcttctcccagtgtgtctctccctgctagtttaggaagaggatggggtagagaagagaaccttttttcttggaagggagctaagggacggggcatgcgggggagaggtcgaggacgagggcatcctgtttcctgtgttgtaaatagaagcactgacaaccagaggcaacagcaattaaatgacgtggtaaaaaattcatctactattatccaggtaagtattattttttgtaagttatctcctccctttccccttagaatgtgtgtggagttcatgtcatggattcacattttctcaccagtgatgatgtcacatgactaacactgtttttcagaatccagtagagacacccaagaaggactatagtctgttaccactgttagcagctgcccctcaagttggagaaaagattgcatttaaggtatatttcaaaagaacagtcacagcaaaaaaggttcattccccttccaaataaacttacttagaaaatcaggttaaatgtgtttgtaaaagcccttcccactggaaccccagtgttgttacgggttcctggtagggctcccagactggtcggggtggacacgccaacatggcatgatggaggagctgtgggaatgggagaggataagagggcttatgtatttgtgggttttttcttcttttttagcttttggagctaacatccagttactctcctgatgtctctgactacaaggtaaggatgtttatttaaaagtaagttgtcagtgtattattaaaactaa

SEQ ID NO: 10850 - DNA, 1208 bp, Homo sapiens
tcactgcaagctccgcctcccaggttcatgccattctcctgcctcagcctcccaagtagctgggactacaggtgcccgccaccaagccccgctattttttttttttttgtatttttagtagaggcggggtttcactgtattagccaggatggtcttgatctgatctcgtgatctgcccgcctcggcctcccaaagtgctgggattacaggcgtgagccaccgcacctagcctagctgatttcttgactagtgggaagtgggggctggtagaggggcatctgtgaggtgtctcctggcaatgggtgcccttagtgagacccagccaaggcctgctgatcccagggtctcttggctctgttcttgttggaggatggttcacatctctaggcacaattccctggtaacaaggaaaaaaacacatcttccactctgctcttcggggatctggtaatctctgttctcaagtgctggtggagcgcttcaagccaggcagtttctgttcctggaagcaatggtgtgagaagggctttatcttgagccactcactgcatagaagcagtgacacctggttcctgattgctcagccttgggtctctggctctagtccagagtgcggggtgaaggctggggagagatgggcactgggaatttaggtgggacatcctggattctgtgggttgggtgaaatgggtagcagtattcagtgccttctaggaggccatccctggcttggaaatgttgtagaaaccatgttttccaggcagtaattcttcagtagctccagtgactataggggtgactctagaggtggtggtctgagggcttagagcctcagtctctggggaacaagctgggcagggagggctagtggtggtgtcctggtaaactacagagcagcaggcagagatgggtgttgtggcctgcagtggtgattctgtgcattctgtctgaggactgagaacagggcaggtgaagtgcagggagcctagtgacagaaggtgctggggactgggtatgggtggcccagggtacaggaccaaagccagggcagaggtgcgtgctttgagtgttgggtctctacctcactgtagtatagcccccttatgggatcttgggaggctgggtgtggtggtgtggtgtgggaccagcaactaactgctggagacaggcaggaccccttgggatcaacttttagttctaaaggggtg

SEQ ID NO: 10851 - DNA, 1100 bp, Homo sapiens
cggaggagatggctccagctctaccctgttgactgtcttgcatgtgcggttgccagtatcctcctacctggctctgtaacatccctcctccccgctctcctgctctccccaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgagg

SEQ ID NO: 10852 - DNA, 1099 bp, Homo sapiens
aggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggtaggagggtctcgggttcgtttagaggatggggcgctcccagtatttcttggagaaaggctgccagtctgcctctcccttctgctacttgtgcagcaaagtcatagtgctcttcagctctttatcgcaacctgcagaggtctggacacggcgtagagctggtgggtaactgaggagttagattgccctgaaaccccaagtcatgggagctgtaacttggttcctcaaccggtgaccttccccagtgagcccttcccaaggaactagcgccaagttgggctcgctgattaacattagtgtgcctctttttctttgtttaaaaaaattattattattttggtgcagatggagtcttcctttgttgcccaggctggtctcgcactcctgggctcaagtgatccttccgccctcggcctcccagagtgctgggtttataggtgtgagtcactatgcccagcccatttttttttcttttttaaacactaacctctttgtgtgtg

SEQ ID NO: 10853 - DNA, 2759 bp, Homo sapiens
ggttcttgcatattctggggctcagatctatttggaaaaaaaacaccaaggccgtgggggccagccagaatcccttcactgagctctgctcaagtgctccaagtgtattttataattgagcaaagcataaatccatattttagagaacttgaaaagtatagaaatacatgcagaaaataaaaatcagctctaatcctacccttgagagtgactgtgaaagacttttatttccttctcatcttgcaccctgtggtttttaaacaaaactgagattatgtcgctttaattaatactttaaatatttaacaatttaattttcgtgtgttattctttgaaaatgtaactgtaactgcattattcactgtgtggatgtcagtttacttcatcagtcccccattcctgagtgcttaagtggtttcgagcttcttgctattagaacttacaacatattagcttgatcttgatgtttatctctggggctcagaaataatttgtcagaccgcattctcccagggccctgggctctgtgctcaggtggagacttggcttggtctgaactctgggtcagagtggctgttttgaccctgggttgcgaggtctcttggtggtttcctccctggggggccctgttatccgtcctgcctgcttttccttcagtggttacaaagggcatgaagagaaaggctgtgcctgaggatggaccatgtccccagtagctcctccgggagggggtcgttggcggttgtgtgggagcccatcttacgtaagggctaagtttggctgcttctatctgccttgaactctggcgcactgggcacttctgcatgcctcctgctctgcaggcttcagcctgctgtcacttggcagcgggagcccagggttcttagaccttcattttcaaatcgagcccctttatctttggatctgagtagacttgagggagaggggcacgagaaatcgagaaactgtgtgctggtgaaacttctcagcatggcttttagaggagaagatgctgctgcctttgcagctttccgggtctgggccacattgttgggatgaaatgggaactgcttggtcctggagccagactgcctggttcgacttcctggttagcagctgtgtgaccttaaggtagttacttagcctctctgggcttgtttccccatatacagaatggtgataaagttatctgtgtttcacaggtactatgagtaaatgtaagtgcttagaatagtcctggaaaataaatgctgacatggtaacagctaatatgtttgagcatgatcttgtgtaaaacagaagtaggtctttgggtgtccagggaattggtttccctttaaccctctcatctctttttgtctttctggaagcacttagtcggtcggctaattggcaagcaggggcgctatgtgagttttctgaagcaaacatctggtgccaagatctacatttcaaccctgccttacacccagagcgtccagatctgccacatagaaggtcagtaacatctgctgcttgtattgcctcttacctgaaatattaaatagaagtgaatagcatctgagtttcaattgctatctttttggaataggaaaccctgcttctcatcccagggaagggagcattaggtatcttccctgcagccttttccccatttcaggtgcctgcgggagactcaggtccctccctactctgatctttggccaggagaagtgtgggtgcttggttgggcggggcctgggtcctgggttcatagtgcccaccaccccataaaggcttctctcaaagcagaagtgccctgtgtgcaattcccccttggcattttcacagctgcctgcctcttctgttgcattgaaagcatggatcataatggcagaggtatcatttgaaaggcttagatgcctttcttcctaaagcagagcttaagtgttttgttacctcaaagatgcacttgaactctatgcaaagtccagtggagtggggtctgtggctgtgtttttgtgagtgtgggtgtgagtttcctcttacagtgattgtatgtcctgcccccatccgctatttaggctctcaacatcatgtagacaaagcgctgaacttgattgggaagaagttcaaagagctgaacctcaccaatatctacgctcccccattgccttcactggcactgccttctctgccgatgacatcctgggtgagcgtgctactgggtgatccggacttcttgccactttcccccaaacctaccccaaacaagaaactccccagacctcaggctaagaaggccaagtgcacatgagtgcctgcgccctctcttctctggcctctgctggtcggttctgctatgggactgtgttctggggacagggcttaggtggtgatagcgctggcaggaaaccagaggcctcttggtccccacatgggaggactacttttcctggctctccccctgggcaccttttaagttttctaggcgtttgcttagaaaggatggtgtagttcggacaggagattgggtgtgtccagggtcgccgttcaccacctgagacctgggtgggactagaatcatgggtttggatggcgcttgttctttcttctggttgagtcaggccttaacagtggccctggtgaaggatctccttccccttcccctccccaggaggtgcctaaattacaaagaagaatgaatactccccaccaggcccggaagtccagtgactcttgggaggttgccccaggagtttggcagagggaagagctgc

SEQ ID NO: 10854 - DNA, 1165 bp, Homo sapiens
cacaggagttggctaaagggcctggggcctgcctactgcttattttcaggagtcttgttctcagcggccacctcattcctgtgttgccctccctgggtcttatagattcatcaacagaagtgggagggagggcactgctggtaggtggaccctgcccaggcctgtgcaaggcccagcactacctccgcagttgcttcttggttgcccagtgtctgtgggaccctccctgcctggccctgaggtgagactgcccctaatggctgctcgtggtattgcaggacaacagccacaggggtgtcgaacactttctgttgttaaagtagtccttcaacctctaccttctgggtgccatgttgtcttgagttgcccttttcaaagatatgctagcccagagacttgcccttgggtctcgggacttattcaaagatgagataagaaggattgtttcagtgaccgctcccccttcccctctacagctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaagtaagcagtgccctgaggggtcgggaagggggacccctggggttgcctgttctgccctggatcctgatcaggaggaggctgttctgcgatccttcatggaagcagcatccttcaattcttgccattgttatggagctggggtgggtttcctggcaaggcagagctggggtttccactggctggcagagtgatgggtgttggagtagagttttgacacagggattcagatcccagctctgccactaatttttttttttaattttttcttttttttttccctcaaagccagtgtcatagtatctgccacctatttattatctgttaaagggggtgatacccacttgttccaggaattagtgttgaatactgtatgtattacatataaagcacttatgcatataatggttaccacaaaaaaatccccaagtccaacaagcctgtgcagcgtgttgggtcatctccatttaacagatgagaaaactgggcctcaggtgacttgcccaagtgagca

SEQ ID NO: 10855 - DNA, 1180 bp, Homo sapiens
taacaaatcattataaaccctctgggactggtgggtgtgtgatgatgcggggttgtttttctttttccccctcctctttgataagcccatcttttcagcccaggtacatttttcccattgtaaacagaaaatggcatgggagggagtgtgtctcggaaacttgctgtattgttaatctgttattaggcaaaagtcttaacaccaggctgggtgctcagatgcctcattgtgagctggggatggaattatgcatcatgaataaaaaccgctgtcaacatgcattggtttcaaaacattagagcatatggtatgtgattatctgtattgtcaagtgcaataaagtgaatttggatataataaaggatgtaatattttagaaatttggtaataaactaaggaaaggatgacagctgaggttccttaaggccccagacacaaataaattgaagttactggtctctgtggccaagtggcagaatggccgtaacatggctatctgtgctcggtgattttcaagttggggaaagctctgctgtcgctcggttgccttctctggaggacgcagggatgatctggcccccatgctgggtggtgggagaggcggtggctcccgttggagacccaggtcttgcctccttgcctggcctcaaggtgtgccctgtggcctgctctgagtggcagacgcatctgcctccagtcaagggccgccttgtgccagccatcaggacatctgaggacccctctcccctagacagtcacctctcagttaatctccagccctctttgtccccatttggtcaatgggaagatgttgctgtaaacgcaaggaccctgagcagccgccccttggaggcagccgtcttctggaacccacatcctacagggccaaattattaagtcatgacagcaagtcaatataagtaatgagaatggtcctctagagaggcgtgagtgcttcagcatctgatgggggctaggaactgtgccaggcttcggtgtactctctccttaaatcctctataaccctataatgctgctgtccctatttgaaggatgagaaagctgagacacagccaatcagttgtggaacagagattacaacccatgtctgaacccaaagcccaggctccttccacttacaaccttttctacaaatccagaggctctttccattcatagt

SEQ ID NO: 10856 - DNA, 1153 bp, Homo sapiens
agccaacacaaaacttctgatgctctgttttctcatctgtgaactggagctaaggctaagtggtctgtctgtttaataagagtttgaatcagatggcctggcatgaagagtcactggcctgagagaatgtcaggggcatttgtaaatgtgtaaagggctgaaaaatcctgagggattattattattgctattgttgttattattcacagacacatccaacagccattgtctgcctccttatctgtcatgctttctgcacgagcgtcagcctgagcttcaatctgtgtgtatatctgcagcttacgtccttgccacccctccagaacccagtttcatccttgtaggtttttccgaagcaggatttgcacaagtggcgtgttttcttaagtatttattttgcaggccatttactcggcatggctatttttacagtgggtaaggagcaaggctaaaaataacttagctcataaccagacaggttctgcatttgacatttacgtggaattcatttgcatctcatttgttcgcctttctgtttaacaggtagaatgtaagaaagctcagccgaaagaagtcatgttcccacctgggacaagaggccgggcccggggactgccttacaccatggacgcgttcatgcttggcatggggatgctgggtgagtctggacaggaccgcaggtcaccatggactgggagggctatggaggcctctactcccaactgggtcacctaccagtggggcaaactgcttcacctttctaagcctcagtttccttgtctgtagatgaggatgataattccccgttccaagacagttgtgatgattaagtgtgggtgtgtgtgtgtgcatgcatgtgtgtgtgtgtgtgtgtgtgtttgtatttataatattgccccatgcctggcttataggatatgttagactattttctctcttttccatctccttcctcaaaagaaggaaaagtccccctctatctgcctcagccctctcatctgagtgggagttcttaagatgtaaggactcctggctgacttgacttgtgtgggctaaggctacgttttctaaaacttgggagaggagggaagtggtaagggtgggcgataatcctgtctatttaaatgattaacatttttctcttgggatatca

SEQ ID NO: 10857 - DNA, 1173 bp, Homo sapiens
agggtggggggctggtgagggtaccaggaaatagagcattaaaagcccagagggcaaatgccaagaacccacaccctgggtgatgagaagttggcacagtgaggcccattagaaaacttcagtaaaaatccgttccatgcaaactggcactgcctcgagctacaaaggatccactcccccgaatcatcccattggggttttgtttggagggggctagggagttctcaggggttgccgagggtcagtttgccagagagctagcaagtgggcagactggcaggcaggtccagagagtggggcccccttcctgagcttctgctcaccacagccagtgtccaaaggccccacctgccctctggccagtgtccctcagtccccccagccccgggccccgggggcggggtgcacagctgcctcgtgtctccctgtgccatttggttttttaacttgagtgctttttggtatcattataaacaagccttggccctacctgtgcctggggttggggaaaagataaaagaaaactcttgagatttttgagtgttgttggttgttgttttctccgttcagtttctttctttttataacttggattatgaaactaaactttaacccaaaattaaccctgcctctctccccaccccaccccgttctccttgacttcatggcaagtttaaagggcagcatggggttctttatgagtctgagagccgtctcccacggtctgtgcccccttctgccaccctaccctctcatggactcccagagccaggtgggagtcccacccatccctctaactcctaacccccaaggtcatctccagtcacacatttttttttttttttcgggatcaatggtgtttgatttgtagccatttccatcaggagcaaagtctctcccagcccattctaggtcagccatgctcatcgctgcactgttagtgaactgtattcaggagtgtgctcccagaccacctgcccacaccagcctgggttagcgcaaggagtaaatcctcaactccgaggtgcccgccccgccccacagggtgcagggtcagcctggaagctacagggcaaccctgcagtgctgccgggcagggtgtgtcaggggcttgggatgtgccccagggcaatgactagactgtatccaccatagtgagagcgctgcctaggc

SEQ ID NO: 10858 - DNA, 1237 bp, Homo sapiens
aaactcctgtgcttttataattattaaaaaggagctactcaagtggaaagtcttttgtgtgggtcctcaaggggctgcccctgggataacttccccaccccaccctgccccctgcctgctagagccccagcagtgagttttctattagatatgattgggcagtaaataccgttcagccctagggtgtgccagctcccaaaaggacttggctctcagcagaatggagtggtcttttaggactgagatcagctctctgggtggccccctgggtccaggcactttcctggggtgggggaggggagttctagcgagggcccagggttaaccagggcttactttccctctggcagtgccctctctgcttccacgctgaccccaccagtactgcaagtctgcttattctttgggctgtggcgtagtggagggtggcctagtcctcaggagagaggcagtcctgtatctcttggggcagtcagatcctgacctcagggaacccccaccgtgatggaagagatgtttccactgccagggagctcccaatttggaaaggcaacagggtccaagcccttaggagcttctactccaaggctggagaatctattctgtgtccttgaatttgcagtttctctggggcaaagaaagatccaagtaaacagaggaaaccttgtcaaagtgtgattccagaagggacaactgagcagcatgatttaaaaagcatgtgccttcaagttagagccagatttggtcctgtctgagacactgtgtggcattggacacatttcctagctgttcaaacccttggtcttcttatctgtaacaggggttacacagctgctcttacaagatgttcggagcatgaaaaaagatcgtgtgaaacacctaccaacatgcctggcaacacagtaggggctcataagtatgagttccctttccagcctcacacctgcagaagctacagcttctagaactttgtgcttcttgcctcattggttttcacctccaggccctgttttgtccctaccagtatcaggcctaacaggggcagagtgatatctaattcttacatagcttttcatcatgattgagaagactacattaggctgcctcgtaagtctgtggtcccagccttggatttcacagtgttttcttttagcagcagtctgtcatgcagaaactgggcctgcagtgagtgcaatcacttataagacacaagcaaggatctgagcctcctggcagg

SEQ ID NO: 10859 - DNA, 3809 bp, Homo sapiens
tttatgttttcttctggacatcctggccttccctgccctgcagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacatttttttttgcttgttttggttctgttctcacttttaaaggatgctgagatggtaatatgactctccatattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactatagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaatagtaaattcccagaaattcagtgtttagacgagggaatttaattcctattttgtccatgttggtgatgtactgtacttcccttccttttctctgcatcccccatcacctcatagaagactctttgttgatcattgtatgttaataatgtataaaatggctatcttgtaagcgtgctgtcctggtactagtgtagcgactttttttctcctctttcttctagtacatattgataggtataacataattaaggtttaaaaaaaattagacatagttattcagatttaggaccagtaaggatagaactttctcttatttatgaaaaaaaatgctaataattttggggcagttttttcctttaattatttttttcaatttcaagtttaattttattttagctgatctgatgtggtttcaactaacccaaggtctcaccatgttaaaatgccggcggactctacggcgttttgtagatccccccccccccacccactgtgaaggggtgccatactaccttaaatgctaatgctagatatgcaaaactggatttttttaatttattttttaaaagagggaggcatggtatattaaaatgattttactaagagaaaaaatatttttttaagaatgctcagaagaaattgataatctgtgtgaatatgttttagatgtttatataccttttgaagagacccagtagcccatagcacaaatcttgtggaaatccgatatgttttaatgtggctacctaggtttaaggttcacgttagtccccccattccatctagaagtccattttgaaagatttttgtaaattcttttaacactgatgtttcagcctcgtctttgtttcagttaagctcaatggcgaacatgggaaccacctttcgccttccctgggggagaaaccctcttggctgatggcttttccccggaattatcaaacagccaccgggtgactttctggcttccagatccatctgcctgagacccccgaactcctctcctcccaagcagaggcgagtgagtggcattagctcccggacccattcccggtcctagctgggcatggggctgacggagatgaccaagccttggtctgctctctagcagcttccacagacttggctcgtggccttccttatatccactgggaacaaacagcctcgcgctctataccaaacagcctcgcgctctatcccagtcgcccattagcttgattcaaacaaagccccagcaggcctttgcgtttttatccttcataaccttcatcttaatttgaacttgtagcttggactttaaggtagcatggctctattgctgtcaatttactgtttcactgcacagcaatcacagccagtgaatgttacacacatcttgctagactagtataaaaatcattgggtaattgttggttctaatgacctgaaaggtgttcagtttttgttcttggttttgttttgtttttgatt

SEQ ID NO: 10860 - DNA, 1192 bp, Homo sapiens
ctgcagcatattcaagaataaagcaatatcgtttactacattttttattgaaggtcagccatgctttctgtattatattgcatatgaaattgtttacaaaagaaacactaactcatacttctctttattggttgcaagtggcacgcaggaacagagggagagtggggggctggtgggggaggggagatttttttttttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgacaaaaaaaaaaataaaataaaataaactgtt

SEQ ID NO: 10861 - DNA, 1243 bp, Homo sapiens
ttagtgctaaatttttcactcagtgacagaatgtgcctagttatatatctttagcgaattaattgagtgaaaatgataacatctctgtgatacttaaatctggtcttttaagcaacacggaggtagtcacgtttcccggaaatccgaacacttgagtgtcagaccacagactgcgttggaagaaaacgagactcagaaagaagttccacaggaccagcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagtaaatttactttgaattgtaaataacatgaagaaacctttataaagattgttcaaatgggactcaatctgactaggcttgctttgatgtttgttagtatgtgggctggctacatctgattcccgggtacatatttcttctgatccatcagacttatacgtgtacacatgttgtggaaccttggctagctggttttgtctgcagagaatctttgtacttcttgctatagaacgattatctctccacttgagaggccaagctgacttgcgctttgtggtaagagtgaggacctgtcattgctgatacacaaagaccaaaactgtaactttaatgtcatggattgagtgtgctggagacagttaacataggcctgcacagactaggctgttcagtaaatacttgttgaatgaatgagtgaacgaatggttatatccagctaaagactggattcatatggtgtagataacaggattgccaagaaaggaggcagctaatttaggtgatgctctccaccagcatccacctgcctccctggggccaaagtgtgcctacaagtccttatcaacttccctgccttcctcgtttccccaggttttactaaatacatgaaatatccctctgagattgcagcctttgtatatgtggtcaagccagtggtttttagctgttagtagtaagctgcttcagaaattccctattttaaaactcatgtagattttctacccagtgattctttgtgtatg

SEQ ID NO: 10862 - DNA, 1178 bp, Homo sapiens
tcccagccgtggtgggctgagggtgcctcccccaggctggggttctcagccggtcacgctcttccttggagcggacctgagcagggcgaggcgtattgcagggtgcgggggctgagctgggtgaggccctctcatgttttctcctggctccgaatagttgtgcctgaggatgcctctccttgaatttatgtgtcatgttaaagattattgcagctgcctctccccgagtggaggtctctaggaagaggaagggaggaagagcctgatgggccttccttatcaggtcatgcaagaccgctctttgcatttttccgtgaccgaacgtgggtgggacgcacaaaagaagatagagggatttaactctcctgagcgttgttaagtttggtttgggatgtggacagatcttctctgtaggtggggagcagtccttccccgttctgtgttgcagaccgcataatacctttaatgtcccaaactgtgctagactgattcaggggctttggcaggctactgcaagtgacccagtttcgttctgttccctccctaaggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgtgagtgctcagccctgtagtggacaggaggcaacagaacttcagaagggaaggtttcggtagcagtctgggaattcaaacatgaaattgagtcaggggtttgccctgtggagaaggcttatctagccaaattagggaggcagcaccccttcctcatagtgaaactgaagttctgaaaagtggaatctggagcccagcaaccgaaagatcattgcaattatagccgcatgtttctgggcatctgctttgggccaggcactgtactaagctctttgcaagcattatctcattctctaaaggccttactctaacttgtaaggaaggcattcttgtttccattttattcaaggagactgcgaagctcaaggaaattagctaacttcttgtaattactaaatatataggagggtggcagatctgggaatcacatctctgactccaagcttatggtgatcatta

SEQ ID NO: 10863 - DNA, 2392 bp, Homo sapiens
ttaacatacttattgagtatgcacacctctctctgctagttacagtgtgccttacgagaagatttttctgattatctgttattgtgtaaccattggcccagctctgtgtaaacaagctctttagcctggcctgctggaggttggctcttcccaagaaagtttttagaactcagaggaactgcatgaagtagtagtgagaacacttagccctgcattgcagaagttaactgatcctctcagcatcactgtgaggtaggtaagtaaatctgaacttgaaacctaaagtgcaaggctaaacaagttgcttaagtccttgcaggaggtatagcatcagaaggtgattcatacactgggatccctggcccccaggcttgtgctcagaaagatcctctgttctgttgaccgcttgatagaaaactggaatttgatttattaaatgtttgacatttttaatgaaaagaaattgattcagaaactttgtgaattttgctcactgttttgagaatctaaagaccctttttcttcttattttagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatg

SEQ ID NO: 10864 - DNA, 1643 bp, Homo sapiens
aatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagta

SEQ ID NO: 10865 - DNA, 3541 bp, Homo sapiens
cagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgt

SEQ ID NO: 10866 - DNA, 1258 bp, Homo sapiens
agttcattccaagtatccaagggatgagcctcagtgcctggagctgagaccatttctgaacttgatgtcagcagttgctcgggaaaagccttgcccttcatggccccttctgacttaggcagcattgctgacatatcagacagaagtttttgatcatattataataataacaataaccatttatttgagcatttaccatgttctgtgctaggtactttacataccttatttcctttagtctttacaacaaccctttgaggtgaacacttattaccaccttataagtggggaaaccgagattgaggagctaagtagtctgcccaaggtggcatagcttgtaagggcgagagtcaggattctgccccagaccagctgactccagggcctctgcttcacggtaaaatggcggtgagtcaggtgcttacgcctccagctcttgctgacccttcccactattgcttttcttcttcccattcagaactgaactttggtctagcttgggttgcatcttgagttttggtttggtttgtttcctcagctttatggccggcacaaggagtatctcagcagcctcgtaggcaccgactttgagatggtgagtagcttggcttcctgcagcactgtgagctgtgtttagccggagcattctgactgtggatgagttacactacctctcttaaaggcccaaaggtatactctacagtgtgaaaaggaagtcaaagaatagcacatatagtccttgttatgtgttttgcaacattgcatgttgatagagaactgttaatgctaagaaaaaggtctgaaaggctatgcacatgctgtgggtggctttctctggggagggtgggattagatgtggtagaagggtagtgggtggtgagagggatatattagggatttttgctttttattccctaaacttaggtagctttgaatttttatcagttgtaatgtatttaggtattactttataattaatttaaaaaataaatataaggatgaaaaatgtcttcttcacctttcatgtggatattttttcaaaataccccatagagaggcaggggtgccatttctgtttgtcacatattttggctcttaaaaaatataggcctgatgcggtggcgcatgactataatcccagcactttgtgaggccaaggtgggaggatcacttgaagccaggagtttgagagcagcctgggcaacatagtgagaccacatccctacaaaaaaaaaaaaaaaaattagcaaggcatggt

SEQ ID NO: 10867 - DNA, 1224 bp, Homo sapiens
cttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaatctatgctggactctccatgggcaaaggactccttggaggggtggggcagctgggctttggactctggacttcagaccccagaagttacatcctaaggctaacaggggcaaaaaccaatcaacaccacgagcttttgaatccttttcctaagaaggtggtttggtagcttcctgagcccgtggtcacagggtcagatatttgctactggggctggggttgtggaggaagatgggacagacgggaaacacacagagggaaagcaccagtttcaagatggtggactgaacacacactgcagtctttctcctctataccaaatgcacagaaataatagacatgagagaaatagaacaaat

SEQ ID NO: 10868 - DNA, 2053 bp, Homo sapiens
atgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgc

SEQ ID NO: 10869 - DNA, 2319 bp, Homo sapiens
ctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaatatgcctctgctgtttattaaattgggaccagaaaccccttcttttctactcattgcctcattagtagtgtagagaagatccaaacatttgattagtttgtgtttagtctaatggcgaggagtgatgcctagcatcgatcccagtcattctaaaattagaataaacctgaaaggccaaaagatttcttcagagatgatagcttttagttcagacctgtttgcttttaggacaggaaagtagtttccccctcgtttccaagccaccttatatactaaagctgctctgagttccttggtgatgtcgggaacaccgctgttttccctcttccttgatgtagtctgctatgctaaattttaggtagcagagagggaaggaagaggcacaggagaagaaccagttgctccactctctgcttgtcctactttcttgctctttctgtaccctgatagagccctcagcatgtttttttatttttatttttgtaacctttccttttttgctgaagaacagtctgctgttaccttgcttctgtatttagtattttatctcaagttcattcctggaaaatctctcctgaatagagttttcttagggctagagatacattaatgcttgtgttgtctgtgaacgtgtcctttctggacaactttaactacttgtgtcattgatctttaagtaacctttgaggtagatgagttgtgtatcaaacctgtttggccatggagccttaggttcagggaggttgtatgattctcttcaggttcaaaaccactggcagggatggggtgaactgctggtctagtgccttttccactttatctcacttgcagcagacccaacattctgatacctaataatttaaaacctaaagattattctttttttttagcttttaattttgagataatttcaggtttgcaaaagagttgaaaaaattgtgcaagagtttccgtataccctctgcccagcttctccttttgttaatgccttacataatcacagaacagtgatcaaaactaagaagttaatcctggttgcaatattgtttaccaaactacagaatttgttcagatcgcaccagttatttcacaaatgttctttttctgttctaggatccggtctaggatcccacattgtattttgttaccatgtttcctcaggatccttcagtatatgacagctcttccgcctttccttgctttcatgaccttgatatttttgaagaggatgtgttattttattaaatgttcttcttatttgggtttgacagatgctttcctatattaaattgaggttatgcattattgggaaggcccttagtgcatcacatcaggggggatatgatgttgatatataaatatacatatatatacatacatacac

SEQ ID NO: 10870 - DNA, 1247 bp, Homo sapiens
tttgtatgatttttcttaaggagctcacagataatcttttaagttaagattttacgggcggtgtgcggtggcccatgcctgtaatcccagcattttgggaggccgcggcaggtggatcacctgagttcaggtgttcgagacccagcctggccaacatgacaaaaccccgtctctactaaaaatacaaaaattagctgggcatggtggcgagtgcctgtaatctgagctactcgggaggctgaggcaggagaattgcttgaacccaggaggtggaggttgtagtgagccaagatcgctccattgcactccagcctgggcaacaagagcaagactccatctgggggaaaaaaaaaaaagattctgctctacaagcaacaagatgggaatgttttatgacaaaagtctaaaccaattggggctacagaatgttgtttatttttagacagtagagagaacagcttccatgcaaggtaagattaaaactttttctgacagactaaatagtgagttttgtgctgtagtagcctattcagaggtgttcttaaatgtctttgcagccacaaataagaagagtaattcgcccaagccagctcgatccagtgtagcaggtagtctatcacttcgaagagcagtggaccctggagaaaatagtcgttcaaagggagactgtcagactctgtctgaaggtaaatttgagggattcagaatgtacttttagtggggtaaatatttattacctgaaattgatgttatcgtggagctttagatcttgaagggcaccaaaaatgctaaagttggatttgaaagtttctttttttgaaacagggtctcactttgtcacccaggctggagtgcagtggtgcgatcttggctcaccgtggcctcgaccggtggtttaagagatcctcctgcctcagccccaccaagtagctgggactacaggtgtgcaccactacgcctagctaatttttgtattttttgtagagacaggttgcccaggctggtcttaaactcctgagctcaagcaatccgcctgcctcaacctcccaaagtgctcggattacaggaatgagccccaccacacctggctggaaagtttcttgatctcaacagaacagacccttaacaaaatacagccattagactatgtattctaaacaccttaattttatttattctttatttttgttgttttcctgagacagagtcttgctctgttttccaggctagggatgcagtggtgcaat

SEQ ID NO: 10871 - DNA, 1255 bp, Homo sapiens
agttatacactctttggatccccagcttttgggtgagtttcttttactaagcaatgaactatttgtgatgtcctgatttagaactccacagacttgaaagtgcaatatttaacattactgtttagatattgtttaggtcaaacagctttagtgagctatttataatgttatttctgtgaaaaaatgtgataagcccccaagaatgaaatactaagcatgtttttagaatacattttgtttcaagttgttagaatgacagtcataaatgaggtttatggaccatttcctaacttaaaatgaagtttgtggaccatatcctaaattaaaagcagatgtcttctttgttttacctctttaggaatcaagaaccaagtgatcatttataacattctttatgcagaaaatttgtgtttttgattgcatgtctgccattttgaaatataagcaagttgggtcatttccatttgaccttcctctaactacctttttcatattatctattcttggcaatattataatgtggtgcttctgtttttaaaatttacccaattaaaattattcttacctctttatcttctaggaaaggaatgtagaagctgtaagaaatgcaaaagatgagcgtgttcgggaaattaggaatgcagtggagatgatgattgcacggttagacacacagctgaagaataagcttataacactgatgggtaagtgtttatgtatgctgctggggtacctggtgctttcagcttctttgagattcagtctttgaagaataagggtgatcatcctaggaaggaatcttgagattttaggcaactccatgttgttacaatttagacagataaatgttagacttgtatttagaaatgataggagagaaaaattttcatagccatttggatgaaaatccaagttttcatagccatttggatgaaaatcctaatggccagtgggcatcattgttaggtagctttttctccaaatctaacagaattccttctactaatgttccatatcctttccatccattttcattggggatgaagaaactgacatttgtaaacatcggcgtcatcccctgccagcattttcttagagatttaaagtctcagcttttgatttctagtagggttcattttacatatgcttaattatatttattgctgacctttttgcttttcgaagattccttcattcttctttgattgtggagcctggtattgaacttaaattttaagtaagaatttaatccaat

SEQ ID NO: 10872 - DNA, 1150 bp, Homo sapiens
gaatcatatgtttttgtttagctttttgtttcttttcataaatgacgtgttaatgtggtgaaaataagtcacagataatatttttcattgtctttttttttattttttatttttttagttttaatagtattatggggccaggtagtggctcatacctgtaatcctagtactttgggaggatcactggaggccaggagttcaagaccagcctgggaaatatagcaagattcccgtctctacaaaaaattttaaaattagctgggtttgatggtgtgctgctgtagtcccagccactcaggaggctgaggcaggaggatcgcttgagcctaggaggtcaaggctacagtgaaccatgatcatgcatgccgctgcattccaccctgggtcatagagtgagactcatctcttaaaaaaaaaaaatagtgttatggtatgagtattattgtgctctctattttgagaaacgtatttattttataaaataatctcaaattcctgaattagtgtatgtgtatggattttctccccagtgctccactccagctacgagaactagtaaattgtcgttgggcagaagaagtaacacaacagcttgatactcttcaactctgcagtctcaccaaacatgaagaaaatgaaaaggacaagtatgtcctcaatttctttgttcaatattgaatggattttgcctttgtattgtttaatgacactatattggtagttgccttttagttatttatgaataagtagtgttatatttcttgtttttaattctttcagtcatgcgctgttactgttaagtaacatattcttattgtgtttatttaacaacagttatttcatgccatgtatacacagatacctctcgccctcccctccccccacacagaaagtactttgctagatgataggcatacaaaggtaaatgagacatgatttctgttaactgtttaatggggacacagtgataatacagtgttaagtcatttaagggacaagaatgaataaatggtcttatgttccatgattgaagaattttgaacatatctggagagttgttatggggagcaggtaaagaaaggaaagagtgatgtggcagtgattggtttttatagatgaagaagctacaacatggttaattgtaaggctt

SEQ ID NO: 10873 - DNA, 1162 bp, Homo sapiens
ttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggtagctaaaatttgttcagcattttgaaataaaaactttgagctgtgttttcattcttgttttaagatagtctgttcactatgtattgatattttagaaagagccctacagaaatttaggtgcatcagctatacgttttctctcctgctgtaaaaggaaaatatcagctatgactactttcttattttttttcatttaaaggatacgtcctagtgaattggtaagtgagaattattaagtagtataaaatttcagacatctcatattaacactttgccttggaggatttgtagaactaaaatgaatgttatgttagatgatggtacatgataatggtagcaggaggaaaaattcacttaaaaactctaaactttacatttataatataaagtattttatatactttcacttgcttcttctgttatgtgtatttaggtaaggtttttgtttgtggggttagatgttgtagaatgcaaagtaaattcgcacattgtgtttatgaaattaatagtggctgttat

SEQ ID NO: 10874 - DNA, 1316 bp, Homo sapiens
gtctcgaactcctgacctcaggtgatccacccacctcggcctctcaaagtgctgggattacaggtttgaaccactgcacccggccagtaaaagaaattttgaaggccattgcagctatttggtagtgtcttgttatttctaggtgtaccttagttaaagaggaaaaataaaacggaaaaaagcttggaaatcagtgatgtgtagttatttggcaagttatacataatcagcagcagccaggctcaagaaaataaaagttgattagttgatcagaaataaaatctgtagagtgaattagatttctgagttgttgttgttaatggaacattctatttgagacctttttcaggtgtgtagcaattctaccatgtccatttttttaagcattaaaaaggaacttaccagttgtaaattaagacaagatccaaatagtcatatttttgtgtttcctctaaaaaaatgtaagatttccatttttggcactgactaactgagcctacatctagattttaaataccatcttgaatcctaataattaaactgatgaaagtgcatatcattgttcctaacatttatgaacccccataaagatgttcctgatctttaaaactcattaatctgagtattaagtagaaacagaattttccaaagcattagacatcactttctcagtttatctgaggtgacttcgtgtacatctgtttctaatatatttgactaattttcatgatctcagattgtgaggtaaatgtaatctggaataataagtgtcttttacctagattacatctctcatttggagtttggcaatgaaactgctatgaagaatgactgtactctcctatctgtccctggatgacataaatatcatttgctttgttgtttaaactgaaataaagttttccaagaacaaagtaagcattcttcattctttttcagttttaattccaaatatactttatagatttttttgcagaatttaatgaggtgatgctttaatcatatgaataataaatgcacctgagatttctctctagtaaagaaaagaaaatatggaaacacttttatggtaagaaagttacttcttggcatttgaacaaataacttgggagggtaatccactgaatcagtcattttcaatttcacttattgtaacttatggttatagttgctagggatcattttgatcatctttgatagaattctttttgttatttctcctttctaaattttgctttgttatgattcagaacagatcatattaaagggccagcttatattttatgtaaaccagtagaagaaaaagtacccaacaa

SEQ ID NO: 10875 - DNA, 1188 bp, Homo sapiens
ggtaggaatcatctcgctgagtcaaggtgaagctgggaccagaccgtggtgacgctgatacctgtcatctgcccctgcttctctgctacaaaaggcatttccttggccgggtatggtggctcacacctgtaatcccagcaggcatgagggaggccaaggtgagtggatcacctgagctccggagttagagaccagcctgtccaacatggtgaaaccccatctttactaaaaatacaaaaattagccaggtgtggtggtgggtgcctgtaatcccagctacttgggaggctgaggcaggagaatcgctcgaacctgggaggcggagattgcagtgagtggagattgcgtcattgcactccagcctgggtgacagagtgagactgcctcaaaaaagaaaaaaaaaatcattttcttgtctttggtcgttcagtatctcttctctgcttctgtatttcctaggaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctctttgctttgtatctgtttgtgagttgatcctggcttctctctctgttctagttttggctgaaaacaaaacaacaaaaggaacagatccttgaccgcatggcggcagcccaccttggtaagggccccagggcccatgcgagagctgcctgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaaggacaaagagaaaaaaaaaatacctcatgactgcattctctctgactagaagcttctgttcctgacaccaaatgtgccaggttagcaaatgagcacaagatgtggccctgattctagttggtggggcaagggcctggtt

SEQ ID NO: 10876 - DNA, 1213 bp, Homo sapiens
attaacgaaaattaccaaaaaattcttgtaaagaaaaatcctaaaattaaaaggagtataccttaaacaacttgcaagtgaaccctaaatgtcatttagatatcatagcttcttcagtgtcattttctgtaggttatcaagattgaagtcctcaagaagttttaaattatgtggagttgtctttcagagctcaattaagtgggaatgttaatttttgatactgactgtgttaagaatgaatagatggtatcaaagcagttagtttggacaatgaagtaagttatttagattatagaatagccatattttaggaaccacataatggcctaacaccctatgacatttgttttcaaatctccttaattttttttctccttgtcttccttcctttcattattttttaatggcagcaagaaaacagctgtcacaatttcattacctttgtgactcagtattaacctgttctaaacagatttggtatcatttgtatccaaatgaacacattgcagctacattttattctttaaattgcaggttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaaggtaaagagttatgaaaatgaagttgtcatgacattaatccattgttaatattctgtttcttatattactagaaaaggaaccagcttcctacagataaactgtttttagattacatttgggttacattttcctttagtagaattccttgtcaatgcctctagatttggttaattttctctggatttgattagttttttaaaacccagattgttagaaggatatgtgggtctagcaagcttttgatttacatagatgtagtaatgtttagtcatttaggtgttatactgtttgacctcataaatgatagttactgattttatttccataacttggacatgaaatacatactgtccaattttatagtgggtagagctgtcaaaattaggctgaatttattcttatcacttttgatgttagtttatggtggactgaattaacaccttacattcctgaccaatattcattatgaaatttgtactta

SEQ ID NO: 10877 - DNA, 1199 bp, Homo sapiens
cttttattcagatataaggaggtaagtatatcatatagcagataaacctgggagagtgaaaaatagccttatataccttctttttattcttggacaactcaatcatattttgagtcttaatttcccaatttataataggatcactgataattaaaattaatgtaaagccaggtacagtggcttgcacctatagtaccagctactcgggaggctgaggtactaggatcacttgagcccaaggctgtagtgcacaatgattgtggctgtgaatagccactgcacttcagcctggacaatgtagcaatactcggggggcggggaaaaagtatgtgaaagcacattatagaccataaggtatttacatagttagcatgtcaagagtgtgttatttataatacagtatgtgtgtgtgaggtttttttccttttttcctagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtgagtactgctagctgaatatgtagagaagctgcatttttaaaaacctgttacatgagagtttcagggtaattttaggtaatatgggacatttggggacggtgggtgcttttttaaaactttatttggaaataattgtgaatctgaaagtggccaaatagtggataaagtctatataccctttattctgattgacttgctaatgttttaaccccactagccttaccatttgtgttctcacactcttacactcaggcacaccattcatacatatgtgtatacacacacatactattttttaaccacgtgggaataacttgaatgcatcatggccttataccccttccgagtgtatggcctaagaataaggatgttctctttcattaaccacatgaaagataccagcttcagtcagtttgacattgataggatacctttaaaaatctgttctattctagttttgtcagttacccaatgatgtcctttgtagcagttttttcccctctagtctaaggtcatatatggcatg

SEQ ID NO: 10878 - DNA, 1198 bp, Homo sapiens
gtgataatacagaagtgaaatattgcacggtttacatttgtcattatccatgtttccttgaaaaggaaatgaatgcaattttcatttacttgggtgaaagataaactaggatgttagtgtttggatatattttttctttttctatacttaggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagtgggtttccttttcagatttaagaaaaactagttgggctacttgattagcttggtaggatcaaaacatcataactgaagaattccaaggaaaaatctataggaaaacaaattctttctcattgtgaagatatcaatttgaaaagaggattaagctcacactaatatcttgctgaatgtgggttacctttttttttccaggttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtaatctaaacccaagtttgagtgaagaattaaagaaacgctatttaaacattagtttaaataactagccatgttttacatttgagttcacagaaaggaaatgtttattctaggtctgcttcgcctgtgtagatgggaaagaattccgtcttgctcagatgtgtggacttcatattgttgtacatgcagatgaattagaagaacttatcaactactatcaggtattaacgagacttttatatgacctgagatcttttaccatagatattcttatctttaactgcacatttctcttgttcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtaaccagtcattgtaacacagtgaagcaactgtgtagttaaaactaatgcttca

SEQ ID NO: 10879 - DNA, 2103 bp, Homo sapiens
cagtcataagcagttctggcctttggccctgcactgtttgttggctttttaggtaggaaccttcttagagtaagactgtcatgctaaaattgtagcaatcaaatgtgccccccatacaactcatttgaggttgagattatgttgctagagtggaggagattggagtgttctaaatgctaacagtttgtcctgcctccttgcccctgccccctgctcctttttgttttcttctactgtaggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagttcgagacaagcctgaccaacatggtgactccatctctactaaaaataaaaaatcagccaggtgtgatggtggatgcctataagatcctagctgctactcaggaggcaggaggctgaggcatgagaatcacttgaacctgt

SEQ ID NO: 10880 - DNA, 1170 bp, Homo sapiens
tctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaattgtgtccgttttcttgagcgttttgattttttacttttagcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctcatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctgacattttggtat

SEQ ID NO: 10881 - DNA, 1170 bp, Homo sapiens; identical to SEQ ID NO: 10880

SEQ ID NO: 10882 - DNA, 1206 bp, Homo sapiens
agtgagggtgatttaattgtagactatcatttttctacctatgggtaaaatgttaaagagtctttaatcaatatatatattttttaacctcaggtctggaatctacagatattttaaagtttgtagatataaaacctggaattccaagccagttctagtttttaaatatatgtgtgtcacagaagaataagaatgctactaaaaatagaatcctgaggacttagttttaaaacctataatttttaggatctgtttttcatttttaaggggctgatgtcttttaattatggttagaaggaaagcacaaactctctcattagaagtgggttggaaataaatattgttttatttataatgttttttctttttctttacaggaggagaactatttatgcagttagaaagagagggaatatttatggaagacactgcctggtaagtgaactttttgtggttgcatagattcaggtaattacaagcaaagccccattcccactatgggcagccacatgattcagtaaattgagctggagccagtcactcactcaggacctcaagggggagaagcagttttgggactgggcagctatggaggtcacatcattcctttgcccttaggcttgagtggaacgctcttcacaccagttgttcctaacagaaccattctcattgcggctttctttccttgaattggtaagctgcctgccttggctgtgggtgagtgtggtttcccagtgaacctttatgtgtggaacaatggaaattatcagaaatcatccctttttttttaggctttctatttctcaaggtacagtcttagggaggtgataaacctgggcatatcatctgtagattgattatgtagtcagggtgggatttaccctcctatttctaaacatgtcatctgcttcaaattaaaaatatgcacatccttttgtgaagcaacaatattgggtcacaataaatcagtttatcctacacattaatttaatagaaaacaacacttaaatgtttttttctaccttgattaccaaaactgcattccattgtttaatttcaggccttttctaacaaagaagctgcatttaagagccttagggatgaagtgcccttttttggaggaggctcactgagccgtgttggaggctgtgtttgtggtcgtgctggctgtgaaactgcctcagtcctctaggacacaccctctcc

SEQ ID NO: 10883 - DNA, 1596 bp, Homo sapiens
gaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatt

SEQ ID NO: 10884 - DNA, 1171 bp, Homo sapiens
ttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggt

SEQ ID NO: 10885 - DNA, 1277 bp, Homo sapiens
aagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaagagtagtaatcattttattttgaagtctcatacaagctctccgatagagaactttcaggcagatcccaccattagcctgtaaacaaaaggtttggcaccagccacctgggaccaaataagaattcaattgtgcttgtccagatatgaacaaatatgtagtgagtatagagtttaccataatcataacaaatattaaagatttccttggagtcagagtaaaaaacaaacaattataatgttgtctagggacgacatgatatgctacctcctttttcctgaagttttattccattatattgacaagatggagaaagcaagatcacgaaggtgtgcaaatgattcttaaggcatggacgaggatttttcaatttattttttaaactgtttccataccctttctttgtctttcttgctttttgtttttgccgttgtatttatgtttgagacacaaccagtcattggtggcaggggcatatagtggtcagtctgaaagggaggctctcttaagagctgtgtgccttccacccagagccttgtgggagacccagtagaaagaaacagcatcctgggaaatccagctaccatggccctcccagtggaggcatcttacatttaggatacttcaagtatcctcagaaatgtattctgcacccccggccccacccatgctgagggaaggggagcagttgccaatatttgcaccatcttcacatgcacctgttgcaacaagagcttctgggaaggtaagtggcattggagctagatcacgtttcacaattagtggttgttcttttctgtgtttgtcttgcactttaaaaaagagagaacacatgcaaatgaacttgcttgtgtgtatttgatggctctaagggctataaattacaaacaaaacacatcccagacattaggagttcataagtgtatttaatgaaattggtggttttaggaagtcaactttagttttgctttgtttgcatgtccactaatttttttattttgatatttgtcttttttttaaattttacagtagtcatcgaaagttat

SEQ ID NO: 10886 - DNA, 1103 bp, Homo sapiens
ttaacacactaagaaattaagagtaaagacaaattgacaccaatcatgtctttctacataccagctggggaaacaaataatctaataaatatattgcctactctaaattaagctcctgcaactggtattatttatattcatctttgggatttctgaacacactctcacctcactgacagtttcttaatatgaaatgcaaaaatggagtctctgagggttggaatttagatccctgaaacggacaaaactgaagtcagtcgtatataacacacttcttcctgtgaaaagagataatagttcgaaaattgaggttagttttccgttatttttatcaagcattcatcctttatgtagttgaaaaattattcaatcatctcgttggttttacggatgaaagcgcctaagacattcttttgaaatatgttagagagagaacttttccattttatctgaaacatctcccccttctcatcttgcttctgtttctgtagaactttcctcaggacaaccaaaaagtacgactctcagtgagtggatttttgtgtgcatttgaaattcctgtccctgtgtctccaatttcagcttctagtccaacacagacaggtaagatagaactagaactccttctcatgattgctcctttaaatatttgtctaagagttgtcatcttttttatatttgttcatgctgaggatattatagcagaagaattttggaacccaagggaaaccttactgattattccatattttttcgacgagaaacctaaaatttagagaacccaagtgacttcagttagataggtagtcgttagctaatatacccttggaattcagatctctttgaacttgtatctaatataacatggcaacagctagtatgagaggaacatactaccagaaaatataaacaatagatatagctagaaagaaatccaatattatatgtaatttaatgtggtcactcactgagtccttttagccactagtatgctttgtctattctttatattacttacaattaggttaattaggctaattccccaactataaagggctttatgaggctcccctcattgatgtgtagtaggtagatagtcctga

SEQ ID NO: 10887 - DNA, 1141 bp, Homo sapiens
attagcaccatttagctgattatgagagttataaaaaaccttttcattgaatataagtaactgtttgtgccatggcatattactacagctaagctttggttctcatattgtttgttccagttcccacagaaaagggagccacaggtctaagcaatctgggaaacacatgcttcatgaactcaagcatccagtgtgttagtaacacacagccactgacacagtattttatctcagggagacatctttatgaactcaacaggtaatctttctggagtcactggcctcttaacctgtgactttgatataaacccaatatcacctaaatttcctcttttttcaccctgtgggagaaagattttatcttatttgccctatttaatatgaaataggccaaggaatacatctcttgtttcaaaaagaaaagatattttgatgtgagatgctaggcatttttgcgcccacatgattgtgatttatgagaatctttggcaacaaattttcctctcaaacttctaggacaaatcccattggtatgaaggggcatatggctaaatgctatggtgatttagtgcaggaactttggagtggaactcagaagaatgttgccccattaaagcttcgggtaagcaggttaaaataatataaaagtatttaattcctaatagttgtttaatcatttttctctgcttgttttttgtgtttagccttttaacttaataaatgtttttggatccttcacttggtataaacaaaaggtcaaattcttttgcttgtttaaatatatgcaaaattactactgtatatgtagtgggtaggataaagaccaaaggtacactctaaattcgggatgtcattcattttactaatttgtcaaacatcttatatgaagagtaaaccttttttggtaatacttcactattagcagtattctaactgcaaggtggacctcagagtcttattaattacatccaatccaatccattttcaacgtaactaagatagttctatctgtagaatacaaagaagtaggctgggcgcaggggctcacgcctgtaatctcagcactttgggaggccgaggtgggtggatcacttgaggccaggagttcaagaccagcctggacaagatggcgaaaccctgt

SEQ ID NO: 10888 - DNA, 1157 bp, Homo sapiens
ctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcagacggagtttcgctcttgttgcccaggctgggagggcaatggcaccgtcttggctcactgcaacctccgcctcccgggttccagcgattctcctgcctcagccttccgagtagctgggattacaggctcctgccaccacgcctggctaggaaattttttgttgttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaactt

SEQ ID NO: 10889 - DNA, 1946 bp, Homo sapiens
ctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttacttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaa

SEQ ID NO: 10890 - DNA, 1153 bp, Homo sapiens
cttaatagttaaaggtagtagttgtgtttgttttctaagccttatttgttgaccagtatagcggatggttagtctttcatttgcctttgaattatagtaatgcttcaaaatagattgtgatcattgtattttaggtttctgcagttcttttttttgtgggggacagagtcttgctcagtcgcctaggctggagtgcggtggcacgatctctgttcattgcaatctctgccttccaggtttaagtgattctcgtgtctcagcctccccagtagctggaattacaggcatgtgccacacctcacccagctaatttttgtgtttttagtagagacagagtttcgccatgttggccaggctggtcttgaactcctggcctcaagtggtctgcctgccttggcctcccaaagtgctgagattacaggtgcctagcctgcagttcttttaataagttaaaaactcttttgaccaaggttatgagactcatggataatattctttgggggtaataatgttctaaaatattctagttaccaagatgtagggttggtgaagttggagaggtatagtgttggctttaagtcactttgttttgaacatcagtaatattaaagctgtaaaatatgtttattcaaatgtttctgtttactatgcaggcttacagtggaacacctctaacagaagaaaaggagaaaatagtctgggtcagatttgaaaatgcagatttaaatggtatggttttaactttttttgggacgtgtgaattaattgtttgtttggagtacctgattccaaaaagagagcctctactttagtcagattactttctcttatagtaatttttcagttttcaaaataaaaggtagcataaccgcagtacagaaactttagaactaatattgtgtaataagccttaaagtaactataacacagtgtgtaagtgttaaactttgatgaagttaaagtgagttaaaattttcttaggcagaaaaatggttttcttaaaaaaggagttattcaagtttggtcagttatataagatttataactgcaaaataatcattagtgttgaactttcttggcttgaaaattgtttttttctgaacagaattttatgctagtccaagtacctcatataagtggaatcgtacagtat

SEQ ID NO: 10891 - DNA, 1220 bp, Homo sapiens
ttgcattattctatcatgctggttgctccttatttcaatcagccttccagagttgttggggttatacagctatcaaggcccagtgggcatcatcaggtttcatcttagctgagccatcagtcaatcaggcccaggtatttaaaggaagctctgtgaatccagtgcctcttgagccagtggcatgcttctgacagtggaataaaagataaagtggctgtaatacccaaggttctgctcaaccagactggctgtactctggaatataccatttccatttgaatagcggtccctgttggttgggctcttcccaccttgttcattttcaaattttagttgacccatccccaagtaggtctagaaagtcacaaggcctccatgggtcagttgttcaattacaattagaactttgtagctggttaatagcagccttctaaaaaagggagtgtacttggtggctgcatcaggcaggtggcgatgttgtactgagataacacctctgagtacttcagcagccattaagtctttacctaaacattttactcttggaatcctacgttgtttctggcatataatatgggaaggaactggaagtctagtaggtggtctgttgtgcagttgtcccactatcaccttggtgtacatgttcgatgatatcctctggcacaagcatttaagtacagtcatgtaagccattaataccagttatatattcaccaacataagtcaaaatgatagtacattgaatcggactaaagggtcccaccattttatatcccattccagtgtatttttcctccatgaaaagcatggactagcgtttttaatgtgcacatgccagttgctccagtgacaattgcccttcagtaatgttatcccctgtgcatggcaggggaagctaccctttgcataaggtgggacagctaggatgttgggcttttatctcacttggccttttttttttttttttttttttgagacagggtcttgctctgtcacgtaggctagagtgtagtagtgcaatcattgctcactgcagccttgaactcctgggctcaagagatcctccacctcagcctcccaagtagctgggactacatacagttgcataccaccatgcccagctaatttttataaaaattttttagagaggctgttgctatgttgcccaggctggtcttgaatccatggcctcaagagatcctcccactttggcctcccaa

SEQ ID NO: 10892 - DNA, 1123 bp, Homo sapiens
aagctgtttttgctgaagaagaagaaaaaaaaaaggccaccccgaaacaacagctagtgaaaaaaaaaaaaaaatcttgttctgataacgtcttttccctggcttgcttacagtggactgtggagtaggaatgactctagagccgtttcaatttaaaaagatttgtaggcaaacttgctgtcctcttctgttgctgaaaatcgtgattgtcttggttacagtgattattttaataaaatgcaattatctgaataattaatgtatttgactactctactgtgtcctccattcacagaggccaaaatgtcaaagatcaagtagattgggagaataggaaaattctcattataaaggcaaggggaggagggaaaggatgaaatatttggaatttcagtgcagtggtttctatttatccgaaatgtcaagggcagtgtaaaatgtatttttaaaatgtgtttctgtatggtttgtgcccattcttggcgtggctgtggctgtacagagaccattgttctttgaggaatatgagggggtgtctttgtccaaagtgacaaaaagaagacttggaagactgggcttcctttgttcctgtgcggtgctgtaaaatttggtttgaaattaggacctcagggaaggaccttcaatagagagctttcatttcctgccagcattttaatcactctggggtttaaagtggatggccggccagcataatggccctatgtttaatagaacagcttgtatcttgaaggccagttaagggatctgtcatccgcccaatattcgtcttttctgtttcctgtccatttatgaagatcacccacccttttaggtggcttccctggatcattttgtaggggagctgctgccactgcttcttaaagaggctgaacagaaacccagttgaatgtggtccagtcttcagcccacgcagggaagttctgcagagtgctttaattagacacgaagttcaccacatttgggagttgattccatcagttgtagagggactgtgtcagatttcacaaaaaatatagaattggaagaagattaaaatttatccatatctcagaattattggcacctattgacctgatatgtgctcacatcatcactgtggtgg

SEQ ID NO: 10893 - DNA, 1156 bp, Homo sapiens
tctatatactaagcaaattagcactctatcatatatattataaatatttttccaagtttgtcagtatctttgccatacaaattttaaattttatgtgtttatcaataatttctggggtttgtatcatattaagtatagctttctcatttctctgtttttaaaaaaaattcttcgttttatggtaaatttttactttcttttccgctacttcctttttacaagactgttgtgcacataatagatgttcaagacttttttctaaacagctatttcaatttaggctgtttcatgtaatgagaggaagactgaatttggattcagaagacctcattgacaactaactataacacattcaaactagttactaggtacctgcctcctgcatttttgtgaatatctaataagatcaagtgaatttaatatatgagaaagtcctttttaaagtataaagaaattatttgggacagtttttcagtgaacacattcatatatgcttttattatttttctccctaattggtctcaggtttgaaataaaatttgtctctaggaaaaagcaaagctcataaatgtggggttttctttattgcttctttgggaataccttaccgatgagaaggctttcctgagccttggttgggagctgaatgagaaggggcaattgggcctctggtgaaaggttctccccaagtgtccaaactagtaccttttaagagtaggatggttggaaaaagtgggcaggacatttgcataatattccaggacagagagttcacttttattgggctgaaagagttcaaaggcaaagtcttctgggaactaaagttggtttcgttggcttactcttagacagatgtgacttcctgtgtcagcgagggaggctccaaggacaagttgaatgcccaagttatagaaagttatgtttgtattggtcgttgttaataaaacagagtatctggggtgtttgaaaaagaaggaagcccatcaacacagaggattatgaatcagacccttccagaagtctctatacctcactttgagagaatttccattttggtttaatgagttggtcacattgcatcatccctttatctacccaaaatgtgaattttaaacattttttatccagataattttttcacagagggaaatgcaca

SEQ ID NO: 10894 - DNA, 1328 bp, Homo sapiens
caactctaaccaggcctggccctctcctgtgtcttgcagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccatccctgagttgctggggtaagggtcctctccaaatgctgagcagagtcctatggcctgagtgcccaggatcccaacaccccctttcatgtgcaacttgggggcagaaggagtcagtggaggattggaatgggaagaacttttgtcctggaatttggatggggcctgatttaagaagcccattctctaagcatcttgcctgttaccagaggcaatgagttcttggggtgccacagggttggaccctcctccctggggatcagggcttgccatgtgctggtgggttgctgtcaaggggagagtctggcaaagcctcatctggggggcaccttgttgtaattgcctctttttaactcagaagatggaagggtggtcaggtgaaggtgggtatctcatgaaacctggccggaaccctcagatgacacgttcctgattt

SEQ ID NO: 10895 - DNA, 1207 bp, Homo sapiens
attattcctccaagtgcacctccaactgcacctgtgttcattgaaagtttgattctgaaatataacccagcctcttgaggtgaaagtgctgagtcaaatatcaccaaacaggaagctgtttcaatagaaattcatattcttggttttcttatattttcagtttgtatttagcaaaaattaaggacattcatttttactgtaactaaaaaagttatttaaaaaacactactactttttcatttttattagtatttaaaaggaactcttttttatttctaacatatgccacatatgggtacatatcaactgaataaaagaaagtaaacatttaaaacatatgagtacctcatgaaatgaataatgaagaatcatctttagatggaaaaatataccaggttctacttatgaaataaattatgtgagtaagattacaaaagatggtagtctgtttaggcaggcctattaaaagcattaagacttgagtactggctattaaagtgagtaaatggcaatattataaagttaaacacatgccaaaaaacattttccagaggactgggattgtaacaataccactaatgagggcaaagaggtcttaatgcaatttgcactttctaaagtttcaaaaagaggctttgagttagtgtattattaatgtactgaacatctggaactgtgtaaaagctatggacattgagcaaatgcaggatttccccactaggttgcattctaacttattccctccctagcgaaatactagttttaaagaagtttgacaaagtaaaatgacaatatccagataagacatgggcattctaaagtgtcttttagtttgtgagatctgactttaaaaaaaattgcctctgaggttaacaaattgaagtgatgtgaacaccaattagtaaattaaatcatctctatcactatatgttggctggtctccctatatgaatagtatttaccctttatgagctattaagtaggatattttcaacaaagatacctcacatttttcatatatgtaagccataagacctgagagacagctctgtgtcatcgtactttcctttaagttagtttttaggtgcctagttaggatacctaagagaatttaacaattgagttatttttgtgtttatttatgtgatttctctggcaagacagaaatagttaagctgtctaaatgtgtaattcaagtgtcacctgc

SEQ ID NO: 10896 - DNA, 2971 bp, Homo sapiens
gtgttgaatttatatttgtaaactaaaatattgtttcatttttttccaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtaagtggtaacttattttcaagggttatcttaatatctcaaacaaaaaggccaaattcctttccaaatttcttggccttaatgttttttttcccttatgttgtaggtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtaaagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaacctgtagtttttgtgtttcattccactagagttaacctgaagggaacggttcaagggactgtattcgaggtctgtatggctccagggcctacgtgtatccctttctgttatgccacatacattaaatggcaatgcaaggtgagagccagttgaaactcttagtaatttaggagaggaaaatgagagtagttatactagagcagttactcaaaagagttgattttttttttttttgagacggagtctcgctctgtctcccaggctggagtgcagtgg

SEQ ID NO: 10897 - DNA, 5223 bp, Homo sapiens
atcttaaggacagactactcaggtttaactactcaatttagtgcctccttaaacatttactttgcacatctaggcaaattagacttagcaggtaattagaaattctttttctaaggattattgtatggtctcaaaaacaataaagctaaagaaaaggaaatagattcaaagtaagttttgcacttaaaaatcacttctggctaggcacagtggctcatgcgtgtaatcccagcactttgggaggccaaggcaggaggattgtttgaggccaggagttcaagaccagcctggtcaacagaacaagaacctgcccctacttaaaaaaaaaaaaaaaaacatttctataatgaattagttaaaagagaacaagcatttttatagtggctttcattcataacataggactaaaatgtatttcatcattttataagatatattgggagaataaggtaaaactaaatagcagattattttctgtttggctgactgattgattacctgttaccttcttaggcctctttgcacctccacgtgccttcagtgcaatctgacgagctgcttcacagtaaacactcccacccacttgactcaaatcagacttcagatgtcctcaggtacaactcttttaccattaacagtttgtcactgcaactttaaaagaatataatgttgattcttatatatttttctcatttttggcaagaatttacagttgtgtaccagtggatctctagataaacactgctattctaacttgagtaatctacttttgagaataatttttatggaaattgcttctttcccctcaaggactctctgttacactcttttttaaggtgactttgagtcttaaatgccataattgaaaactgcttccaaaatctaggttggaaataaataaatgacttatgcagtttatttgcttttcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatctttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatactttttaaaaaaaaaaaaacaaaaacaaaaaacaaaacttcaaatggaataaattattcatgaagccttcattgttgtgtcttattctgttgaaaatatttccatattaaatttgtgcaaaattagtagcaatatttttgtgtcattataaatggaaagggacagcctagaaactgattaatggtcttttaatttttctgaagtattttattttaaaaaggattttaatcacatacaaatgtacagtatgtagaataattgtatatttgtatacctaccaattccttgtaggctggccagttaggtattgtctagtccaaacaagctaccttcaaatatttaaagcttagctgtatcctatttttatt

SEQ ID NO: 10898 - DNA, 1195 bp, Homo sapiens
tcgtctaggaaggattggtcatggagaattgaaaggtaaaattgtgcttttattagtatttatatttccgttttatgtaaattcacacacagttctgaccacgtctaggtatatatgttgaataaaatgcaaaggttatcaaataaggaaccacatatgtctaggccacaaatggcttaattcaaattttaaaaagacattttactcttattttaactttaatatcagtcttattactgctgttcttaattgttttctgttttttccactttctgattgttatttaactcatcctctgttgagcagataccaattgaatttggtgtatcctaatattagggggataaagaatgttcagtagcatcagcagtaagaattttggcttgatgatgactcgtgttggaggaatacactaatttaaaagccattaactatttttatattttaactttaacttggttctacaggatattaataatgctgttactttgattttttttttttttttttttttttttactgttgatacccacagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccaggttagctatctttagtttatatcagatttaattctttatgcagttaagtttttaagtattatatacaatttattcttcgtttattaaaagaaaaaatgtctttcattttcagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatggtacgtaatttgttccattttggtagtctgaagaataccccccaaaataaattcatgtccaatacctgaaacgtgtgaatgttaccttgttttaccaaaaaatgattttgcagatgtgataagttaaggatcttgagatggagagattatcctcaattacgcaggtgggcccttaatgcgataacatgtgttcttataagaag

SEQ ID NO: 10899 - DNA, 1176 bp, Homo sapiens
gaaattcttacagtaaagaactcttctaagtttgcttaatccaatgttttaaatttatttaacattgggcttctaataacaaaaatcagtgactcacagaactagagggagaaggtgtataaatatatttgtataacaatttttattttgctttgatttagggatatttgtattcataattcatgaattggtgttaatgtatacctaaaatgactgcatttttatgctcacttatgtctgcattctgcaagcttttattcaaacaaaatggttctagtactattgttatctaggtgttttttcattagagatattttaattttgaaaaaaaattaatgaatttctaatgtaaaaatgaaaaagacctatggcaccatttcacccttgatatgtttatttttttggcctacttctaaaaacacccttgatatttttatcataactgttaattgcaaatggttaagcttattttaagtagctttcatggttggttttataatgtgtatctaaatacaataataaatttactaattctgctttctgtatgtatatttgtagtcctgtcgattaggtcaacatagacctgtttctcgactgttaacagatgggatcatgagagttggatctactgcatcaaagaaactatcagaaaagttggtagcagaatggttttctcaggcagctgacggtaacaatgaagcattttctaaactcaagctttatgcacaagtctgcagatatgacctaggtattgaatttgtatttattgtataaggctggtgttagcaaaatgtggcctgctccaccagctgtttttgtagataaaattttattggaacacagccatcctcatttatgtattttctctggctgcttttgtgctacaacattggagctgagtagttttcatagagactgtgtggctgcaaagacaaaaatatttattatctgaccctttacagaacaagtttgctgatccctaatgagggatcccatcaggtaggaagaaattatgggttataaataaattttctgttgcctctgtagggtctgatgttttaataacttgaagattcttcatttgttacagtttagagataaaataatttatagttaatctctaccaaaccaagaaatagttctttgttgtagctaagaaaacgacagctgtttaag

SEQ ID NO: 10900 - DNA, 1190 bp, Homo sapiens
agtcagtttattctttttgtagtgctaagtatttggagaaggtaggtatggtgtgaggcccatcaatcagtcaattctagcactttccagactgatgtaacttctatttagtagagtagaatacgctttctggccagttgctgtaggattgtaggtgatgactaagcttagccaagccattaatttataataattactaacaggaaatatcaggtacatttaaaaatgagtaaatttcaagccttgttataccttttaaccttaactagaatcttacctctatatttaaattagatactaaaatatttaaatcatgtaagacataatctttggctgtctgatcacatggctattaaatgagcatgagataattggcttttatgaatgtttctgcatgcccttatattttatttaggtcacgagcaaagtatttttttcccctttcaaattcaaattattttacttttagtattacatgtgaaaaagaaatgataaccgaagtgtctaatactattaactggtattatacttcgccataatagtgatactgtaaatatgaaacctttattttcacttttcaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacc

SEQ ID NO: 10901 - DNA, 1206 bp, Homo sapiens
ctctgttgcccaggctagagtgcagtggtgccatcttggctcactgcagcctctgcctcccgggttcaagcagttctccagcctcagcctcccgagtagctgggattgcaggcgtgtgcaaccacacccagctaattttttttgtattttattagagacagggtttcaccatgttgaccaggctggtcttgaactcctgacctcaggtgatccacccgcctcagcctcccaaaatgctgggattacaggcgtgaaccactatgcccagcctgggcagacaaatttttaacagtttatataataaactcagtgtcatactttatcttcacagtaacgaagtataataagttgatttttctctggaatggttattactggtttccttttcttttttataattgcacgattatttgccacatttttcactgtgttcttatttggtaaaacagtcttttgttacttatttgatgtctgctttgggtttctagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttggtatggatcctgagtattattcctaaggggaaaatgcatgattgtatgtgttagttatattttgctgaataacaaacaagtctaataactcagtggctttcaacaccaaagatttattccttaatttcctgcccacattacttaagggctgcatcttagctggtttggctccatgtatctgctcattctgtaacctaggttaaatgaatatcccagtagctaggacatgctgttcttatgagaacagaagaataatagggactgaacctaaccatgtaagtgtactcagagcttctgctgggatatggtgtatgttacatctgctcacattgcattagacaaagctagttaaatggccaagccaaagtcattggggcagggaaatatattctgtctagagggaagcatgcttaggatgggacagttaattgtgaatgaattaatatttggaggctgaaaagttgacaacctgtgttgtatgatgttttaacatttggtaaaactaccacttccaataact

SEQ ID NO: 10902 - DNA, 1910 bp, Homo sapiens
ttctctttagttgatatttgctctgggccctggcagccgatagagagccttagggttccctccaggggtgccaagactatctgcctctgtcttcaagaaactctcctttgcaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacataagctttcttctgttagatcttttggcagcaaacaaccttccccccaagcctctgaattttgtgggtgtgtggtggtgtgtgtctgtgtgtgcatgtacacacacactttgtctagctcactttaaaagattcatcaaatggaattttaaaaataatctgaaaagaaatagatatttcaggccgggcctggtggttcacgcctgtaatcccagcactttgggaggccgaggtgggtggatcacgaggtcgggagttcgagatcagtctggtcaacatggtgaaacgccatctctactaaaaatataaaaattagcctggcgtggtggcgtgtgcctctagtcccagctacccgggaggctgaggcaggagaatttctggaacccaggaggcggaggttgcagtgagccgagatggcaccactgcaatccagcctaggcaacagaatgagactctgtctcagaaaaaaaaaaaaaaaaaaaaggagaaatagatgtttcaaatatgaacattcttttggcaccaa

SEQ ID NO: 10903 - DNA, 2849 bp, Homo sapiens
tgggcagcttctcccttcctctcacccctgcaggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagcagacctctcgcctgttatcttcctttactgtggtaataaaaggagccggagcttttagcagccagacacatgacgttagctctaggcctgagagaaattgaatatccgcaggctgggcacagaaggtaaagcgattagtgatattgatcatggcctaggggctgaaaaggcccagcggttgtccagtctcgacccagcagaggcagtgttgtttccacatggttagataagccctttcctctcagcctgagagggtggcctggatggtggagctgcaagagcctgataagagccttggcaaggaaggtcccccagtgtttaatggacccctttccctttgaaatcagtctttttgatccttaagaagaggagcaaagcttttggaacgagctgagattccactttagatccacgtacgtggctcaggcagaaggtgagtttttggcaaatttgggtgggatcgtactgtgcgctttgtgccttgtcacttaaagcagtggccgccaacctttttggcagcaggaacag

SEQ ID NO: 10904 - DNA, 1135 bp, Homo sapiens
gctggaatgcagtggtgcgatcttggcccactgcaaactctgcctcctgagctcaagggattctagtgcctcagcctcccaagtagctgggattacaggtgtgagccaccatgcccggctaatttttatatttttagtagagatagggtttcaccatgttgtggctggtcttgaactcctggcctcaggtgatccactcgccttggcctccccaggtgctgggattataggtgtgagccatcgcacccggcccacacacacaccccccctttaatggtggagttgccaacagttgtccgatgtggcagagagaactggggagcagagaaggagcccatcactgggagggactgaaaaccagctcctgggcactgcagggcagagcgtgtgccgggtgtgaagggggtcagtgcccctgtgctggccactgtccccctagttctgatacagttgctgccaggagaggctggaccgtggcaaggggccagtggggaaccggggcgggatggggggcagcagcagtgctctggggtctgcttgtggtggccatggtggtggcagttgcagtggcaactgtgggccatggcagcacttttccgtggcgcacaggccgctgccgggtgaggggagagccccgcttgttctcctcctgccgcctctcctcccatccccagctgctgggtgctctccggccggcatgaagctgtgcaggcactgggcactcccttgggctcttagcggggccttctcattgctgcttcgctaggaaccacccgctctcctttcctcctggagggccacgtggggccgagcacctgggacagccgtgctgagctctacccggccccttcgcaggcctcgtttctgggggccttcagttttggaaacctccctgagggcccctctagagtgcgggtccgccccgcccctggtgtggaggggaagtgccctgtccctgtgtgctgacaggtccctgtgtgcagcatggtcggggcacttctactctgcaggcgcggccgggcggggagcggggtggggggcgggcgggggcgtggggggagcggggctggctctcctgggtgtggggtggggaggcctcctcatcgccagcatggagttaaaaaccaggatgggg

SEQ ID NO: 10905 - DNA, 5412 bp, Homo sapiens
cccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgtatagattgactgaatttctttttgtgacgaattcagttcttcccattttgtcactttggtcatgttccatagacagtggcagtgccccagcccgagccgggcagtctactcatcaccttttatatcctatttagtcattcacttgttaattcagtggagcacctcctctatgccaggggacatggccctcaagttggttgcagtctaccagaggagacatctacataaatacttgtggccgggcacagtggtctgtgatcccagctgaggcatgggggtggctgaggtgggaggatcacttgaggccaggagttcaagaccagccttggcaacatagcaagaccctgtctcaatcaatcagtcatttttattaaaaaaaaaaaaatttcttttagccagactaagatctaagacaaatctttttttttgcatttcttttttctttttttgagacggggtctcgctctgtcacccaggc

SEQ ID NO: 10906 - DNA, 1164 bp, Homo sapiens
aaagtatctcacaactgggtactgaggtatgctacagcatggatgaactaaaaaacattaagtgaaagaagctagatgaaaaagattgaatctttatgaattgaattgaatatgtatgaattgtatgagtctaaatggaatgaaatgtccagaaaaggcaaatcaatagagatagaaagtagagtagtggttgcctggggctggaggtgggaaggaggagtgactataaatgggcacaagagatcctgttggagttctggaaatgttttaaaattggattatgatgatggttgcacaactatgtaaaggtactacaaatttttggattgtacatttagagaaaaaaatctgtatggtttcaactagatctcttaagaccccatagtatccagtgagattgttttcctccaaatgtatttttattttttgtttattttatttctgcaaagtgaaacattgagataaacttctgttttatattattttccttttctatgtcttgtatcacagctctccatcctgctgaaaaaccaagatgatcttgataaagcaattgacattttagatagaagctcaagcatgaaaagccttaggatattgctgttgtcccaggacagaaaccatgtaagtagcccttgtcatggtctggcagctgaagacaaagcttgctttccttcaggaacttgtctcgcctccttgacagacattttcgttcctcagccactgccaaattgagagcataagcacagcacagcccacttgtcagtggccagtgaacattctgcatttgatttcaccgaaaagccagattgtcagtgttaacattgcatctaaaggttatttgacttttggtgagggaggaaggaaaatactttatgataaagaataaaattcttgtgctctaaatttatgttttttcaattagattttgaccccaacaagagaaatttgattcgtttggcagtgccgattaggaaagactgtcaaagatttgagactgtcatgctttataaacccaactcccacaacaccttgcctttcccttggaacacttgtaggaaacaaacttttccttttgttcagtggaaaaagccatgggttgggggcctcttataacttatcagctgttgctttacccaatggcaggcagtctgtagggtgtca

SEQ ID NO: 10907 - DNA, 2800 bp, Homo sapiens
atccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtccgcactctgccaccctcctgccccttccacccaccccagctctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcatttatatcagaggggtcctgtggcagtgctttcagttgtggggggtggaggtaggtttttgcttagcaggggccaggtatggtgcctggcaacgagcctgggcctttcaagcagaagagaacttgactccaagtagaggggtcctggggtgatctggctgataccattgtcagtccagaggtgtctgcccctttcctccagttgcccctccaggagctccactggggtggtcccaacagggctgatttaccagggtggcactgctggccctcacaacctgaacgtcaccagtggctgagttcccggagctttcatgatatttggtagggtcttcctggcccagaggacttccttcagtcccatctttgcagggcaggggtcaggtgtctccaagagccacctctccagtacccccttgtggtcatctgctactgttgcttaaccgaaccaagatgatccttgccatctgagacctctggtgcaggaag

SEQ ID NO: 10908 - DNA, 1209 bp, Homo sapiens
ccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctattgtgtggcctgctgggggatctgtcacaggaagggtgcagactcaccatggggcgggcatggggggacagggccagccccgactacctcggccctgatgggggcagggagctagaagtgggtgtcagttccctgacacaccattgagaaatgggagggctcctcttcacagcgagggcttcatgctgtcacacccacagtggttttggaactgaaactccacctcacccctcagttctgggttggttcagacccaccaacttaccatatgcaccccattgtgaagaggcctgagagcgggagggccaggctgccagtgggtgatggcgcctgtcctcgctgcacttcagtgcctggggtgcaagctgccgcgttccctggctggttccagctgtctagctccctcccttcttcccagccctttgacctggaagtaagttagcgaagaatggcggtaaccagcagacccagcaagtgctgcccaaggttttagtgacccctggat

SEQ ID NO: 10909 - DNA, 2163 bp, Homo sapiens
taatttttattcactaatgtagatattggcaattatttttataactatcttctagaatgttatggtgcaagcctaagtttttgaataatactataggcagtattctaatttggatttttttttaacatatgtttcaagcttaatttgaattctctcgtccccactccctttctctatttattaccccttctttctctaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaatctcagagtgccgccttgactttgtggagttatcctacaagagtataagctcagaggaaaattctttctgttcgataaaagtcagcactgaaatgcttttccttcaaaagagttcatctgaatattccttttgttattaccattcaatcattttaaaaacattttatatttttagagccccatatgttatttatgggctcctccctgcattccacctcttaagactccattaactctcctgtgaatgcgaggacaaa

SEQ ID NO: 10910 - DNA, 1269 bp, Homo sapiens
gttgctgaaggggggaggggaacaaaaacgcgacatgcgcagtgaggaacgcgcgggcagaagggcggggccggggctacggctcccggaaggcgcctgaccttaaagctccagaacgcctcacaggctcctcagatactctgacgggaaactgcagttgggtggacagtgttcatgacccatctagaaagtgggtctgcgaatgaagaaaaagtggcgtcaaggggctagccaaaaatcccaagagaaaacgggttggacagaaaccatatttacatgaacatgcctatagtttaaactgttgcatatactactagagcgacactcttgcctctggccacgtggtcccacacagcatggccacctttagcttccggagcaccggttccgtgtgacgtcaacttgacggaatcctaggtaggaggattgggataggcgagggcagttccggcccaggggcggggattatgtaattttcccaaaagccccacctcgcctcagccgggcgggagagagggaggtctcgcgctttccccggggttgcgtcccgccccgcaggctgcgcgcaggcgctgacgagccgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacaggtaaggagcgggccaggacgcgctcgtcggcgtggccgggccaggccgagcggtgactccgagttgcttggcctgtagcccggtccggttgagataattgtaatggtttgggggaactttcccacggagctgtgagcaaatgatagccaaaagggcagagttagaggaaatgtacagtgtgtgccggaggatgacattaggatgtattgattctcttgggtggggagaaactaggcaaaggggtttaatagaagcaaaaacctctgtggccagtctcttctggaggtttctaaaatgaaacgtgtttgtatccaacacatataaagagacagaggaaagtctgcatgatttccagaatactcgttttggccgttgtcaggaagacctaatctaaaatgacaacaaggaatgatggcctcactcagtcctctttcctcaagtctagactcagtcgctgaggaactattggatgagcttgcagaaaataa

SEQ ID NO: 10911 - DNA, 1184 bp, Homo sapiens
acgctctgcgggtaaataaaattttcagttgtgtggctaccatcctttctgggagtctgtccctatagtcagttctgataagcctcacttcacatagcatttttcctttgcttctgaacataccagttgtttaagttccaaatgtttacgtccaataatacatggtttgagaaataaaatataagctcattttcctcaaggaagttagaagtagccaaagttactcctctgggtttgaagcttacctgaacaacttcccttccaggagagccttgagggagggagcactgtaggaagccttagataaggatctcagccacttttcaaatttggtggattatgctaccaaagagaaaccaatctgtggttcctgtgaaaattcctcccttagcgtagtgctggctgaaaattaagcaaaagttcccccttcccacttaatttcctctttgtcctcgttctcttcttctgttcttttctccctcccttgacttaaccttgaattttgttcaatgcagaatgcctggtttcggaaatctcgattcaaaggagggaaaggaaaaaagctgaacattggtggaggaggcctaggctacagggagcggcctggcctgggctctgagaacatggtgagtctagactactacagtagtgcctttatagttggtctcatgtcctgaaagtcattaggaatattctcatctacccaggaaagcctcagtgagtttaaagccctgtctagaagggaatttgtatttaatctgatttgagtcaatgcagtgctcattcttatggtaactttctattgaagaagcatctttgtgtacttggttgactaggcttgctcaggaaattattctagattagcagtgatctcacactgtggtccctggaccagcagcacatgcaaactcatccccaaccccagaccttgtgaatcagaaactctggagttggggcccagcagtctggttttataagcccttcaacactggcctaaagcctgctgctaggtaaatgttgccaaagggtcactgtaaagtctagccatatcttgtcattaaactcaggaacggatcaggaatttccaagtcgggagctagtttttctcacaaaccaggtaacaaatgtacccttttggtggcctttcttaactgcctgttttctgtcaccttgattccaagcca

SEQ ID NO: 10912 - DNA, 1512 bp, Homo sapiens
agggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggacctgtggatcgtttgtcatttctgtctatgaattggtacatattaagaatagtgccgcacacagtgtagggacagatagggaagtgcttattaaaactgtcagaaaagacaactcttccattatcctggttttattcaggaataggatgggggtggggagggcttaagt

SEQ ID NO: 10913 - DNA, 1194 bp, Homo sapiens
tccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattggtggtgcctggacctggtccttgaacagcacagccctcattaacagactggagtcctagaggacttggcccacagagctttattggagagatacacacaaaggctgtccactcacttccataatttcttgatggacatgtttttctcactgtccttctgcatgacctaggggtgggagagagaatgaacattaagttacgaacacacacatgccctagcccactgccccagagccaccactggcaaaggcacaaagatggaggcctataccttggctactgccatctcaaagtcctcctgagtgacatggactcgccgttctcgcagggcatacatgccagcttctgtgcacacgccctgaacaggaaaaggaaattgaggccccactgctgtgcccctcatctgtggcccttgagcccagagcttcctgcctctgccctgttttcagtgggtactccaattaccttcacttcagcccctgatgctcctggcatgagctcagc

SEQ ID NO: 10914 - DNA, 1333 bp, Homo sapiens
ctctacaaaaaatttaaaaattagctgggtgcggtggcatgcacctgtagtcccagctactcataaggctgatgcaggaggatggcttgagcccaggaggtcgagcttcagtgagttatgatcacaccactgcacttcagcctgggtgacagagtgagattgtgtctcagaaaaaaaaagactgggccagacacttgggcgctcccagagaagtcctgccatagggaggggggcgctgctccaagcccgttggaggttgatttgtgtggttattacagtgttcctgcagatggcagtcgagtgtctcgaggaagtccctcgtgggctgcaagagggcaccatttccctgcctccagtctgcccagagtcctgcttccatccttcagggcccaggaatcttcagtatccggagctccagggctgaaatggggcttctctttcttgggatttagcatagcttgagatttgagagctcagcagcaccatctcacacccctttccatccccagcctagcaaacagaagaggaagttttcttcattctttaagagcctcgtcattgagctggacaaggagctgtacgggcctgacaatcacctggtggaggtgagagtgggcctggggcaaaagcaggctgatgtgcaggtttggcagggaaatggcctcagggcccttgggaggccctgtgttcacgcccacccccttggtgataagccatgcttccctccctgccagtggcaccggatgcccaccacccaggagacagatggcttccaagtaaaacggcctggagacctcaacgtcaagtgcaccctcctgctcatgctggatcatcaggtgacagagaccctggggtcatttctgggcccacagggacccctcaggaggggagctggttcctagaaacccttcctgtccctgccctattttcccactgttctactataagaacccgttctgactcccctccatccaactccagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccaggttagccagatgccagcccccgttttctcagcccttgctttgccttgcctgctgggctactccttggccacagcctgcagactgctgccctcactggtcctggaatggtccactccactgtgcccacaagccaacgctgagcctttcgtatttcctccagatcttcagttgtggccgactccgtttctcc

SEQ ID NO: 10915 - DNA, 1242 bp, Homo sapiens
ggagcttggtcacatctgttaggaatccaaaggacactatgacttatttaaatcttgtcttactaaacctctcttgggcacgtgtgccagaatttctcttgttgcttcttgagtctttttaatttcagtgttttttcgtttgttttttgtttttttgagacagagtctcgctctgtcacccaggctggagtgcagtggcacgacctcagctcactgcaacctccgcctccttggttcaagcaattctcctgcctcagcctcccgagtagctgggattacaggtgtgtgccaccacgctcggctaattttttatattttttttagtagagacggggtttccccatgttaggcaggatggtctcgatctcctaacctcgtgatccgcctgcctcagcctcccaaagtgctgggattacaggcttgagccaccgcacccggcctaatctcagtttttgaagtgctccacaagtcattaggcaccaaaacattttcacctggggaacactggcatttccctgattagctgtgaagcaatctagtggctaagtgtgaaatcctgggtgcgcaggtgttctcactcccgccgtgttctcagtgcagtggtggtcagaggcccttccaaggagacatcactctgatcagttacagatagatgttctggaagatctgcaggtgagtagatccagcagagtttcttcccaccaactctagaagaaagggccttatcagagttgaccctgagcctttggtaaggttttgtgtgcatgcgattcagttatctttggcaattcttttcttgctgcagtgagagattaattggttgctgatcaaaccgttcatgcagatggggggacctttggattgtacggctttctcctcttggctgctttcttttcaggaagttggactttggccaggtttggctttcccagagccgttcctttctctgtcctttccttgggtcctcatggtgtgcccattggatccttggccttgtgatcctctgggaactgggggccagttccacttttgcagccttctgtgctggaagagaagcccagcgccctggaaggagcctctttaagtcccccatgtcgctttctctctctgctcttttagtgtctgagattgcctttctttgaatttcccagtgtttcttttccttgtcccttccctcaccaacctggagttattttggttgactatgtcctggctttggcttctcctggcaggaagtcatca

SEQ ID NO: 10916 - DNA, 1521 bp, Homo sapiens
gcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcac

SEQ ID NO: 10917 - DNA, 1729 bp, Homo sapiens
aattaaaccattaaacccaatgaagtgaaaaacggtggacatctgccaagtaaaagcataatcaccacttaaacagcttcatctgtgctcctatctgcgaatgacagcgtctcctgtggagaaactgctctctgacttctggttttctcactgttttcacagagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttgg

SEQ ID NO: 10918 - DNA, 1339 bp, Homo sapiens
tgttgtattaagtaaatttgacctttattctttgcagatctgtgaaatgttgtcttctgaggggccacgtgtatctgtagtgctgaggactccttgggcctctgaagtcacagagagaaccctgcagggtgggggaccagtgtgtgacagccctgctttgcattttctttgagaagtgctgtcattttgcatttctctccaccagggcaatcttcaatcttgagaggtgtgatcataacttgccttgtttcttgtcgctacagagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactg

SEQ ID NO: 10919 - DNA, 2771 bp, Homo sapiens
tcaagcaattaatcccaagttgcttcagttggtcgaagacagaggttcaggtaaggatgactgataggaaatgttggtagttacgagtcacatcgttgtctacaaatccatttaaatggtattggagggtgagtaaaaccttgaatgtgaaaacttaagctgaaaaattgtaaaaacatttcacgcctaccatgaatagatctgtttctttctgtccacaatgatttgtgtcatagacataattgatcaatttgcaattgttttcttgacaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgcttaagatggtctggttttttttttgtttttgtttggttttttttttccatgaaaacaaatgactgttcctttttatttaatttgggaggcagggggaatcagaaggcccttctttataatgagctattcatattgcaggagtcagaatgaattgatacaggtgaatttttagttacaggctaaattgcataaaagctttgtcagcttccagcatcaggggagtcatttaatagcctttttccttatttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttacttgtagattctagtcttcacaggctccctggggctcttaactagtcacactgggagtcatgaatgtctttccaataattcagggaattctagagatcctcaaactgtaaggtctattcatactcaacacaaggaaaaaacctcattaaaattaatgactaatcaggaggcaacgtaaccaaaagcacagtgaatgaaagttttcatggtaggttcaacatgggtttattgctagaaagatccaggggatagctttaggtttaacttcggctcaccaacgtaactttctaatcatttatttcagtaatagctagaagtgggtctgaatgttttcccagagtctgatacgtgtttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctccccattctctctttttatttatttgcgtataggccttttacctggtgtgagttcctgaatgtggaaaacacctggcagtagtacccagctttgcagttaattactatctagctggcctttttttaaacccttgtatacacttgtaaagaagaactatttcctgaacctggtacagcactttactaatgataaaactttactcctgaattacattaactcaattgctaagctgttacccctcttaatcaggtagtagtttggtagtctcacagtgaaatgtagattgttcctttttccctgaacctctttaaaggttttcgtaactgaggctggtataagaaatcatggactttggaatcaaacttcctcagtctgggtataccacttttccactttctgggtaggtcttaaggtctcgacctatttaaat

SEQ ID NO: 10920 - DNA, 2761 bp, Homo sapiens
tagattttagactacatagctaaagatgtaatcatttgtggtggttttatatagaggttagctcaccctattcagctggagctgttttgggtattggacaacacatgaagaaaggatctgctagtataataagttagcagtttaaaactagtatccaggtttgtgctgaaagctgtttctctttccttagtgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtatgtaatgaaaagggttttatttgtcattggtgctaaatatcctaggtattgtagttacacttacgtatttaattaaaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagagtaagtgtcctttgaaatatgtgatcaaactgaattgtgttttcactcttaagagtctgatactaatttttccccccaaaatccattagcctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaagtaagttttattaactctgttatatttgcttcctaacaactttgctgtaaaattgagggatcattgtttggtgagttgttttaggttatttcagttggtgtgatttcatttagttagcctactaatcctgaaaatttcttgaatccttcaaataatggctgtcaccatttatagctttcctatagaaggaattcatgtgtcccctggttgacttaaggaccaagggtcgaactgctcgataagtggattagcaggcgtttcctctttgacttccagccatgtaaattgaacttaatgttttgctgaccataaatgtgtggccctagcaatggtcttttaaaactcaggatttttcctttctctctcctattattagacttattcgtctaatggaagagatcatgagtgagaaggagaataaaaccattgtttttgtggaaaccaaaagaagatgtgatgagcttaccagaaaaatgaggagagatgggtatgtgtgagctcctccattgaagcagattgattaaaacagcttaggaaagggcaaacttggatcacgagcagtggatttttttcatatctgatagtgaatttaactttttcatttctggcgaaattaaagagatctgtgaccaaaagtggtcaagcactggagtctgaggttttcaatgtgagtttaataacacaacttgtcttttaacttaggtggcctgccatgggtatccatggtgacaagagtcaacaagagcgtgactgggttctaaatggtaaatatttcaaatgaagtatttttcccccttacttaacctagctagaattctgctcagataattgatcatgtatatgccttcctttgtagaattcaaacatggaaaagctcctattctgattgctacagatgtggcctccagagggctaggttagtacaaactcgcattcatggcttggtttcccagaagatctccatttaacttttttaaagaaagtttattgctttctttaacctgcattttttctaagttttttttcacataaaggtgctgtctttgtggcaaggcctaggcatgacaatcggaggactcgagggggatggaggactagtgatcggctggctgcttccagtcgattagagaggtgaaaaagctgaacgtgtgccagtaatcttcaaaaggcagaacatatcacctctgccccgtaaactgttctctccgagggaaaaaatggaagttatcctcacagttcactgccgtggtatttcttctgtcccatgctttgcatgactgccatggtacagccttgtttcaaactgttcactgtgatctgtgggtctttgagtttcagtgagtttgctgaaatgtcgaagaagtagttccaaacttcaatgttcaatgaaatttttgttcaagtttgaaatggagagagcagctttaaaaggtactaagccttttacaaattggtgagtactggcacatgagatctagagcaggagcaacttctcacacatagtaagtgggaaaagaaagtgctttgaaagttcctccctcacctacacagtagtcgtcatgtcgagacctgccagagagagacacattctcaagtgaatcctggcttcttggaagcgcttgcctagacgagacacagtgcataaaaacaacttttgggggacaggtatgttttcttgcagctgcggttgtaaggtcttggcaagacaagcagtgtggccagaattttgaacttctgatgaatgtgtaatgcaaaggaccttgtacatttttttgtttcaaggtcctcaaaatgagcacatgaagaggttgctgtgaaactttaagtggccctactgcgcagaagcattcagatgtcacttgatgatctgtaagggaacttgctgatttgggaatgtgcttagggaacacacattccttttgaca

SEQ ID NO: 10921 - DNA, 2761 bp, Homo sapiens; identical to SEQ ID NO: 10920

SEQ ID NO: 10922 - DNA, 1182 bp, Homo sapiens
aatagagctttaaaagaaagaaattggctgggcatggtggctcacacctgtaatcccagcactttgggaggccgaggtgggcggatcacctgaggtcaggagttcgagaccagcctggccaacgtggtgaaaccctgtctctactaaaaatacaaaatttagccgggcatggtggcgcactcctgtaatccaactacttgggaggctgaggcaggagaattgcttgaatctgggaggcagagattgcagtgagccgagatcgcaccactgcactccagcctgggcgacaagagtgagactccgtccccgcccaaaaaaaaaaaaaaaagaaattactctccataacagtctatgttatcaccaacatatataaaaacatgatttagatttccatttcaaagttacattacccgattacttccaaataggtgctaagcaaaaacccccaatgtattattgaaccatggacttgcacctcatgtttaatgtgaatatttatttccatgtccctcttaactggttttttcttgtcttccctctagctgtattgttatttcagatatgtgatatctgttttcatactcttgcctttccatcatgaatgcttagttatgaacagagattcctttgtagagctcataggcagtacagagaggtaagtcttgcctcagagggccttgtatcttggtgtagtttttaaatagtgcatagtgtatagtgtatagtgtacattttgttttgcacatagtttgttgccccgaatgggttttttaccaagcctttttttctttcatgtatttacagtccggagcacaagattctcttctttcaaatacaatgtaattcgctttactttacaacactaaatctgggctttgaatttccagtgcattggactgattggattgttgggagttagaggctgttccaaccatccttagtttgggagagtggctccttctgcttgttttctaagcgtacagtcaacgggtgccatttgtggtatttaacatgttaggatgattgttccaaatgctgagttgttttatttctagatgtaattagttcactttatgtaatattcttctctcagactgactttaaaaacaaagttttatcattttcattgtatttgtatttattacagagtgttttagctttgatattctttgtattttcatt

SEQ ID NO: 10923 - DNA, 1106 bp, Homo sapiens
tgacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttggtgttgaagatctgcatctgattttgaaacgtccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaagctgcaaaatttaaagttatcaagtaaataggtcctctgtgttctgtttcatgtgatggagtgggtttcagtctgtgttcttggagccaaagggttcctcaggggtgcctcaggagtaatggtttaagagaagaggggcaatgagagggagcgagggggaaggcctagttggtatttgagcaggggccttaggctccatatccccaccccctttacccagaacagcccatttttcttatgtatattggaatttcaagtaagctttcatggggtgcagtggggcggggaggaatggatgggataaaaaaagtggagattttgctgctttaaaaaagttgagaactacttgtgtagtttttaagtattttaatgtatttcatttgg

SEQ ID NO: 10924 - DNA, 1122 bp, Homo sapiens
gattctctacctcctcttctcccgtaggcctccctcaaatagaaacaaaacacccaacacattcaaattacatttgcaagtaaaatcagaaaaataagtcatttttgagtgaaagagctctttattctagttattggcatgtatgctgtaagtttagaaagaaatttcatcaagactcagctctagtagacgtcctgtttcctgggagcttctctgatttgaagggttgctctgctgatgctgcttttgttagtagtttaccacttttcatcaacattgaactgtgtcacacctcagggttcatttatccccattagtctgagatttattgttagacttgaggctaaaccgttaatgttagatgcttgtaagatgcggtgttgctaaagtagagatttataataataattaccagatctgaaaatacatgtgattatacgaaatcctgccgaatgtttacaggctctatgtgaactggagatttttacgaggcattgaggctcaattcttggctctgcagaaaggatttaatgaagtaattccacaacatctgctgaagacatttgatgagaaggagttagaggttagtgcattagtattataacatcactagtgtaacaaggaaggattgggaattattttgttacttagttttagaggaaagcatatttctggtgctttctaagtttcatggttctatgcttgagaattcttattcacaggaaaagtctttcatgcttttgaaggcctttcatgctttggaatttctgtgagtgaacaatctgtctctctctctctttttttttttctgagacagggtctcactctgtcacccaggctggggtgcagtggtgcaatcatggctcactgcagccttgacctcctgggctcaaatgatccttcagcccctcaagtagctgagactacaagcatgcaccagcacccctggctaatttttttgttttttttggtagagacagggttttgccatgtttcccagggtggtctcaaactcctgagctcaagtgatccgcctgccttggcctcccaaagtgctaggattataggcttgagccaccatgcccagctgtgagcagtctctcttatattgtgaaaattttt

SEQ ID NO: 10925 - DNA, 1223 bp, Homo sapiens
ttttttagattgggaggtctgagggacctcttaggaggcaataataaactgatttgaatgacaaaaaagagccaggcctagggagagtaggagaaaagaatatgccagatggaaggaagagcaactgctctcaggtggaatgaccttggcaagttcaaggaacaggaagaatatgagtgtggctgaagcagagtgggagggagaatggtgggaagtcaggtctgagggagaggctatagctagatcaagcagtgttttgtaagccagtctcacatccacagatacgtatggattttatatcaaatgtcattaaagtcatttaaatacatagttgatgacatgcttatcatttgcatttctttggtgcttagagacttcaggtttgcttttactcagagttcttgaagtcattatacttgtattagtcattctgttttcagacatgataagtggttgttactgcagtatatatatattgtctagagaactctacttttgatatctaaattgataacatcttttccttgttaattttcaatagaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatggtatgacaactacaaaggaaaaataaaatgtggtttactgatttcagtttgctgaggaagtcagaaaatatattttgaaaaagttattaatctgagcttagggattctgcatgaaaataaatataaaacctcccaactttgaaaagtctttgaagtggtagatgactacctaaccaacagtttgaccttgtgctcatcattcagcctcagcgtttgtgctcttctataatgaagtgagatgactagtttataacaaaggtagtgtgagaagcatacgaaatgaagtgagactgttttgtaaataggcactgtatagaaaggtaagatggtattgttactgataacggtaatctgaagttcaacctatgacataattttttagacatatatatttagaaataattttaaaggcatatttctgatcatatatttgtattgtctgtaattttggattatctgattggattgttgtaaatgac

SEQ ID NO: 10926 - DNA, 4256 bp, Homo sapiens
caagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttacactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtcactctgttaccatttcatttattttagttttatttgagaaattaagaccagaagttttgctcatgtctttttcacttggaaatctgacttagtacctagttaatttgtctctctcccatcattttaaggcgttcgcttctgttaatcacagatgatctgtccttgtgttgtgctgcttgactaaaagcactgttttgttttgttttgttttgttttttaatgataggatacagggtggcttttcagtctagtaaacatgaggaggggagagattgtgggtgggtgtgggtgtgtccgcatgtcccaaatacagcacatgcccatttttttatggtacgaggttagggcttattaataaatgtatactagatcttgaagtgtaagtctaagtctgaacattttaaacaagttggactttatggctttttcaagttccatcaagtagatactagt

SEQ ID NO: 10927 - DNA, 1154 bp, Homo sapiens
gaggggaagggaaggagggagggagggaaggaaagggaaggaaagggaagggaagggaagggaagggaggaggggaagggaaggagggagggagggaaggaaagggaacggaaggaaggaaggaagggagagggaaagagggagggaaggaaggaagggagagggaaagagggagggaaggaaggaaagaaggaaggatggagtgcaatctaagctttctattccatatgttcatatttcatttattggccttttgcccattggttcttcttttgtgacttccctattgatatcttctgcccatttttccatttttaaaaacaaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggtaagatatttaactagttttttaataggcagttgaaatccatgtttaaaatccattgccaccacccttatatttaatctccaaaaggtagtagacatggcattactctttaaatgtataaactcttcagtcgaggaatttaagtatcttgctcctatgtctaagtaccagtaaaataatctagggaatttcctaacttttcccttggctttcatggaagggattatatggaatatcctattccatagtaattaaatacacgttgtaataaagtgatattataatattgtccaatattattttgattagaaatactggggctgtatccctaaattttcctaaatgggactaagtttcagatcttccctcagttgtctaataagcatttctagattttacagctttttataacagtgtcacataaatgatgacttattttcccaggttgatatttcagtcgagataagaaaagtctttttagaagtatatattattggaataaatgtcaatataatgtttacacattttgattggacttatattaaaggtgcaatctcaaatattctttcttttgacgttcagaaaaagtataactatt

SEQ ID NO: 10928 - DNA, 1151 bp, Homo sapiens
ttggttacatggattcattgtacagtggtgaagtctgagactttggtgtacccatcacccaagtaatgtacattgtatccaatatgtagtttttagcccacacccccttttccaccccctgcttctcaatctccaaagtccattataccattctgtgttcctttgcatacccatagctcagcttccacttataagtaaaaacatatggtatttggttttccattcctgagttacttcacttagaataatggtgaaagatttcctcaaagcaacagaggactccttggaggggaatgatgcttgagaccaatacactgttacaattgtctagggagccagtaatgatgaatttaaccaaggctgtctgtggtggtagaaatcgagaaaaagagcaaggaataaaagatattttagaagaaagcattgagaagacttggtgaaaaattgaattacctactaactggtgcactaaattttatatcatcaaactctatgtacctagaattggtttaactatgttttcaaaatttttgacagttcagacactgatacgtgactgtcaagttatcagagagactaaagaagaccagattgcagagctgaaaaagatatgtgaacaaagtacggaatctctaaataatgactgggaaaaaaaggtaagctacataaaatactaatggaaaacataaaagtttatgcttccaagtaacatatttaattataaaagtaatagatttcacagaatatacagaaaagtttaaaaaataactaaaattccaggctgtttagaaatagctactgttcatgttttggtatattttcttctggaagtctatggtctataaaatagttttcatttagaaaatattcttttgactagctcttgaatttaattaatgttctggatttcttatcagccaacagattttaaacaaaattagttaaatagcactaaaacagtttttggaaattaagccattttaattttgtatttgggccattggagtatttctttcctgaaattttagaaaatataatatggactagaatttattgtataaacttattttatttttgattgacatgtaatgattttacattttttagggtacagtgtgatatttcaatacatagatactttatatactgat

SEQ ID NO: 10929 - DNA, 1210 bp, Homo sapiens
ttagcagtgtggccagaactaaatcccaggtttttcactctgctgttcccaccttatcaagggattcctaattttaattcctgggttgcactgtttgtgtttctcatcccactgatttctttttttgtgtatgtaaagtagttagtgattacagaaagagataggatggcacataattaaaaactttgtatttaacttttcatatttaactaatattcctttagtaatataaacattactatcagatttatctgttatgtacttctgtttattgtatttcttagacagtagagtgcaactaaaatgtaaatatgttatcacttaatgtattttaatatctcataattcaatgtacatttaattttttaaatgtttgaatgtaattgaatttgagtatttgaaaggctgttttcaaacttgaaacttgatggaaattttagtggtttattatagtacattttgaaagaataatttttctaattttaaaaaatcagtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacaggtatgtaaagagaatgggattttgaatgtgtttcatcatttagtctgtctttggaactgatttatacattctgtttttccttttttttataatggaagtagtttacttttcccttaactgcacattcaagattattttatatttttagccatttaatagatacctgttaacttcatatatatttttgattgcttgacaagtggtccctgagcatctttaaatgacacaattatgtattttcctttatgacaagcatacattaaaagcattatcaataacttgaacaaaatatcctgcaaatccaccttgaacaatatttgttttcacttaatgatataatgaatgtaagcgtaaaccccattagactgtgctttcttactagagtattaaacttaaataggtttttttagtgcaaataaaaataaatttccaaatttttgaaatgttcaaaaaggccattattgtggtagcatagtttttggctttagggaagggatagatttaaatttggacttttatcaaatttttacttttctgtttggc

SEQ ID NO: 10930 - DNA, 1304 bp, Homo sapiens
gatacccgatttatcctgatgcgactattatacattacatgcctgtatcaaaatatctcatgtactgcctaaatatatatatctactgtgtactcacaataattaaaaattaaagttatttaatgataatctagagattttatttttgagaaaatatttctttgcatttgtctttctcatttaccaattacctaataaagtgaaattgtagaccaggagttagcagacaatggcccatgggccaactcctgcccacagtctttttttgccaggttttattggaacatagtcatgccatttgtttacttatggtctctgagtgctttcatgctacagtggcagagtagttatgccagagatcatatggcctgtgaagcctaaagtatatactctctggcctttaacagaaaaggtttgttggtccttcttttagactaaagcaggtgctattataggtctttgtaattgaatgtttcattttataaaaaataaaatttctaatagttcttctgtatttatagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatggtaggtatcaatgaacaaaaggtatatattagtttcatttaaaaaaaagcgtcaagttatcatccctttggggaatggtaatactattaggttgtatgtgctagataatatattaaaattgttttttttcttcctgattcaatttttttccacctttaataaaatacatgtattgcttataaggggagtatccttattgatttagttatgcctcagtattcaacagtatttctaaaaaactgaaaacgaaattttttatattgagctttactttttgctaattttcactggattgtaatggtaatttttacgtaattcagtaaattctagtttttaaactctttcatatatattatttaaacgtttatgagaggttggagtgcatgatttgtaaaagttcctttttactctaataaaatgacagtaatggagtttgaaagtcattttctgtacttaaattaatttcattgtcaaaatcagctttattgcaaaggcagttattattatgcttggtggataaattgtcactgccctggtccttgtaaccataaaatataccttggtttgtttggtatttgagtgcctgtactta

SEQ ID NO: 10931 - DNA, 1137 bp, Homo sapiens
agacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggttgtgctgggagaccggacccggggctgcagaagaagctgaaggctgactttgtcccctccccgaaaaagggtgttttgatgcctcagggtctctgaaatctcccgggaagccccagagctttcctgaggctgcctggccttgatcaacttgggaagacaaaattgagccattatctcctcttggaaacgaatcttgccagaaaaacgggatttcagggccttccctccctgcctgggtgtcgggccaccagaaggctctgccggacgccaagaagacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccagg

SEQ ID NO: 10932 - DNA, 1099 bp, Homo sapiens
tttttttttttgtgggggagggtggtgagggcaaaggatttgtttttcaaattatgtgtttctcaggttaacaaagttattttagattctctgccatgccagcaggtgttagagagagcctgaagtgttacatatggcagaaaataaatgtctctgattactttgctacctttaaaaaaatctatatgtgtttgcaaaacagcctagggggatctaccacctacacagcatgaattattcataagtcataggtgcacatgtatgagcaagttatttttgagaaagaaactgcctataatataataaacctgtcaggtctttgggtattgtttaatttgtgtgttgttgctgttttatctggactgcatcttggggggtactgggctctgcttctggtttttagtttgcctttgaatttactgagctactagaaagacaaaaaaaagctatttttatggtaatagaatacagaatgacttaggtgtaaaagtacacgtgaagaccatcgtagaatatacagctttggagttttcttaagacacagtccttcctactgaaaaggcttgctcacctttggagaggattgtttatattttcagcctgggttcctttatgcagtcccaacttagaggggagcttcggtttatttacactttgctttgcacgataacttgtatgcgaagacctctttatatctttcagtaggtcagagggctctttgtcctggttgaagtcccaaagtgtcagtgcagctgagaatgtttctcagcctccccctttacagaggaagggtcctggattttcataaatccagaccatgcctgcttcctataaatccatgtatatgacattgtactgtatctgatttctgtgccagtcatctgacctgattctttaaaccccataaaggtactggctatatgtagtagttgtatcctaggtaaatatggtgattaaaatacttctcttctaaattataaagataatgagttttgcattttattaaagggtcctgttattagtgacacaggatttttttttaatgcttcatacatatagttcttatctaaacttgttcagctaacttcatagatcagtt

SEQ ID NO: 10933 - DNA, 1324 bp, Homo sapiens
agttttagactatgtatgatgtgttgttgtaatctccatccaccataggatagagttaaaggcattctttgcaggcatattttgtatgccactgttttttgaaatgtgaaaaaaacgttggcatacttagttattttttggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttctcactatgcatgtgtaaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttgaggaacaccattaaagaagaaatataatgtttgtcaaaaatgtatcaaaattcatcagaatctggggcagaaaactacccttgtttttcatgtctttcaattcttctaaaataccccttattgaacttgtacacaatataaaatttaaatagccatcttaaatattctaccatctaaaaattgctttgaatgaattttggtaaaatccaaaggaagatgtttaccctcttgaaacttatggtcttgtcacacatttaaagcaatatatgtccttattttcctgaccttgtaatactacttttatatttcagaggtatctcgaaactacaatataaacttttaaaaaaaaataagatgaggctggggaacctttcgaatgaacccaatcttcctgatgatccattcaaaaacaggtttttggaagaccactttcgataggcaatcctataatcaaagtacatttttaaaatcaggttgtaaaatggcaaaggtaaagaaaaattactgacatttcttctatgattggagtttagtttatgttggccagctacaaccccttttaatcctcagacagtttgggataaaagagtgcctttggttaatggttagcaagctccaggataagcgctgcgtgcctcttgtattcagctctacctttctgctaagagtgcggttcatttgtgtgtggctttgcgttccaggctgtgggtctctgtgtaaggtggcagacatagacttgtaaactgcagacgtgttaatggttagcataaatcacagctggaaaactgagccggcaagttacagcaccactctttctctgtatgatgtcagatcaccacat

SEQ ID NO: 10934 - DNA, 1145 bp, Homo sapiens
accccttattccatgttactcagtatataatacaaggaagggtagcattgtaaacaaatggaatcccatggcactattacttagctcagtaataaaagctgttttgaccaagagtctggatatgcagctcctttttatttaagagagagcatgtgcctgtttacaaactatgagcagttactagaataaatatcaaagtgtacagttacacaaactagttttttatttttcagcaagccttcagatttgaactttagtttttatatgttagctattccacttctcatggctgttttatgtgtctataagatagggacgtttggttggatgtgttgtgatttcagcattctatggcagaaggtgtctgtccttgtggctatactgtccttgagttcctggagatgagagccagttctgacacactgagtgaatgaggcacatgaacattgctgggctcatccttaaatctgtgtcactgttctctgcttttagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaa

SEQ ID NO: 10935 - DNA, 1217 bp, Homo sapiens
gagaaaacttataaggatttttaaatattttcttaggtaaaagtgatacaaataattccggacctgaaattaataagattcgaacaccagagaaaaagccaacagaaccaaaacaggtatgctgcttagttactgtgttgtcctagtggatttagtctgattggtcatcttggaatcttgatgttttaaagaaaaatacctccctttgtacacttatcctttatgtttattttttcacagggatatagtgagccatattgccttctctttcttcatcttttctttggctgtgctatttcatgtatcagtatacttttctcaaattctgttattcagtgataaaattgaatttagagattttctatgataaggtagtaaatgaagacagagctacaggtgtgtcattacaagtgtgtcattatcgtgaagaaggagaacttcttcctcagagaggggaagacttactcaggtccctcaccttattctctcatcatacccactaagcccttaattctttatctgtccattcatctattttctctgcttctgtgcttataaactacttagagaaaatcaagtcactggttgaattagtgccactggaagttcttgttttctaatttgaatggaaccatcagggctcccctgcatttctttcacacgtatctcacttcctttgcccagttgtctcagtgactcttctcaagcctgattaccttccacattctattatcctattggatggcttgcctcagactgacctcatcaggatttgctcttgttaatttgtaaccttaaatttagcacttttaccatagccctgagcacccttacttcctgatcaccagtctcagaggaagagttcccgttaagattaatctctacttggcggttgctcacgcctgtaatcccagcactttgagaggccaaggcgggtggatcatgagatcaggagattgagactatccaggctaacacggtgaaaccccgtctctactaaaaatacaaaaaaattagccgggcgtggtggcgggcgcctgtagtcccagctactcgggaggctgaggcaggagaatggcgtgaacccaggaggcggagcttgcagtgagccaagatcacgccactgcactccaaccagggcgacagagcgagactctgtctaaaaaaaaaaaattaatctctcctcttcaactaccacatagaccttgtcccttctc

SEQ ID NO: 10936 - DNA, 1164 bp, Homo sapiens
aaagttaacggagctaatgaattggtctcattttgtaaagtgatgttttcattttatctttttatttttgtataagtcaaaaactgttcccaagaaatacaggacacaggcttggattagtctagttcacttggatctaaattgatttgagaaattccacatcttgtgaaatcttaactactacttaaaaacattactctatcctttgtaagactatagatttttagaggccgtccgtcttgtatataaacccattttctctttctttagaatttttgaatattttgttaatttgctgacacgagtattttcaattcaggagttttagccttggaaacaatttctttcatttaaggcaagcactgtaatttcaggctgagatgatcattgccaaaggtttttggcaaccttgcccacactccagaatgggaaaatgcttagctgcaaacatttctcagccacgttggtcaggatagttcacaatcatgacagccaaggagaatgactgtaaatgagaaatacgtaattcatgcccactccccatagacttcagactttggattttagcagttatttcttccagacagcttggcaacactatacatcatctgctttaaatagtaagtcccttaggatttttatttcactttactaggtcaaagagacttctattttgtaagatttctgagagtttgcatttaacagttataataaaataataggagcagtagctcagatgtcattgtatttattccttttgtgttaatatgcagagattatatatctagacacacttaaacaagttttctgtttttgtattttaaggtggagttgaattaaaagcacagatgacctatttgaattttacctataataaatgaacattaaatgatgtggttactcatattaagttggaataccagttttttgagttgagactccttaggctaagttcttccttaacttttccccctgtctattaaactatgtttctatgcaattatgactttaaaagattatttttatggtaatctgacatgtatacattcatatggaggggaaacaagtaaatactataaaatgatttaatgcctcaaggaataattaccaattttaagccctcagtttcttcctaatctgaaaaatgatctattttccattaca

SEQ ID NO: 10937 - DNA, 1172 bp, Homo sapiens
atgcctttataaggctgaataatctattgtatgtatatgccacattctgttgatccattcctctgtccagggatactcgtgttgcttccaccttttggctattgtgaataatgctgctatgaacgtggatatacagatatctgtttgagtcactcctttcagttcttttgagtatgtatgtaagcatggaattgctggatcatatggtagttctctgcctaaatttttgaagaactgccacactgttttccacagcagctgtaccattggacattctcaccagcagtgcataagggtttcagtttctccacatcttcgccaatgtttgttatttagcaataacattttaaaaaatgcaatgcttttattatatcagtggttcagaatgacaatcttaagtcttttcttaaaaaattttctttgtaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggtaattatgtgttaatgttgagacattaaaggggaaatgtgacatgatttgtatccctatgtgtatatttattcatatgaccttctggctaattaaaaacaggtttattgtagcctgatatccagtgggaacacaaaagcatattactttggatctatttattgtatgcataattgtgtattcattgagccattattcaagagatatttcctgagtgacttctaggttctaagcactcttccagcttctgaagatacatgagtgaacaaaatagacaaagatctctgcccttgtggggcttacattttattggtggggcttactttttactggtaaggagaggaagattaccgtaaactaaataggaatattatatagtattttacatggtaagttgaatggaaaggaaaatattaagaggaattaggaatgatgaggacggtgcagactagcttgtgattgtaaatagcgtggtgagagcagacctcactgagaagctgacttggaagtgagggag

SEQ ID NO: 10938 - DNA, 1203 bp, Homo sapiens
agcaggcagtgaattctgaaagtctttctctgtgatccaaatgtggcctagtcccagctgtggtttgttgtcaattggtggctgttggctggtctgcttagttatatcagtgaggaaggggacaatgttagaccttgtactgctgggacttagtgatgtcactgatgacaggaagcttctagttggttggttagtttcattggcctgatctggagagagtggactgagaattactggggctgtgagaacttgccttccctagaatcatggcctgtctttttcccacacaggaacttgagcttgttcctccctacacaggaacttgggggccaatagcattgtccctgattttcatgttttcactggttgtattattggagaattttactgtttaaaatgtaaatgaaaaatttatattctcattcagttcacatcagcaaagcattactcccatttaggggtagtttttttttttttttaaatgacatctgctaaaatgggatcctttataaatcagttttagttacgatattattttctccaaacattggtgataactttaatatgtatgtgtgtgtttgtttttaaaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggtaagtgtcaattgaaatgaattcagtcattcaaatgcttaaatctaaagtgtgttcacattggatttttagtactcaagatctcttttctgaagttatgtgttcatttcatatcaagttctttaatgccaggtttggcaattaaaggttgaattcatttacatgtttattaagtttttatatccaaataaaataagtattaacaaatataccttttctgtgaccataattatatcaatgccacatagtatatgtatgctgtgaattacagtcataatagtatataacacattctgctgttatacggtatctgaggatgaatttcttcataaagatttttatgtatagacttttctaagtttatagttaacagcaactcttttaaattatgttcatttaattaattgctataaaatctgtgcttttaaa

SEQ ID NO: 10939 - DNA, 1151 bp, Homo sapiens
gacgttgcagtgagctgagatcgcgccactgcactccagtctgggcaacaagcaaaactctgtcccaaaaaaaaaaagcggggggaataagagaatacagattagtgaaaaaatattcccagagaatcccatggtagtccctctttaaaaataatacttatgctgggtgcggtggctcatgcctgtaatcccaacactttgagaggctgaggcgggtggatcacctgaggtcgggagttcaagaccagcctgaccaacatggagaaaccccgtctctactaaaaatacaaaattagccaggtgtggtggcatatgcctgtaatctcagctacctgggaggctgaggcaggagaatcacttgaacccgggagttggaggttgcggtgagccaagatggcaccattgcactccagcctgggcgacaagagtgatactccgtctcaaaaaaaaaaaaaaacttatttaaaaaacagtaagaaacatttaaaaataatgtatttaccctcctacaaaggcatgtctatagttccttgtctttggacatgtaagaattggaggcaaagaaatgtggacttggagaaatctggggccagcttgctctccgcaggctcaagatcaaccatcccacatagaagcagtaaaaacaataaattgttttggtttggtaatatgttattctaacgaaggattttaaacacttaagttggctattcttcatataaaaaataacttctttttttttttccttttcaagaaggcaaggtctcgctcaaccacactggagtgcagtgggaatcatagtttggggcagacatgaatcctgccctgaagcagtcctccccacttaccctcccaagtagctgggactgctggtacatgccaccacaccacatgaaaatacaatttttttttccttttttgagacggagtctcgctctgtctcccaggctagaatgcagtggcacgatctcggctcactgcaacctccgcctccagggttcaagtgattctcctgcctcagcctcctgagtagctgggactacaggcacaagccaccacacctggctaatttttgtgtttttagtagagatggggttttaccgtattgaccaggctcatctcaaactcctgacctcaggtgatctacccat

SEQ ID NO: 10940 - DNA, 1699 bp, Homo sapiens
caaatcattcacaaatgcagttatttattattattattattattatttccttagagatccttgttctgacactgttattttttaatcatgattacctgtgagcctgttaatctctctaggtaattgagaactgattataatttataatttttttacttctggtttataatctaatgggaaaactttgcatttagattttctatagatttaaaaattagagctgaatcattgcttcttcgtattattttaacttgacaattattaaagaaatgtacttatgtattttaggggggtatatgttcaaataggaaatttgtagaaatgatgtaatgtattgatttgtaatgatgtcacgtctttatctacaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatgtaagtaaatctggtcttaattttttgtatgcatttaaaattagactagtttccttcgtgattgatgtagcagagctatgctgttgatgtggtataaacctttgtaacttaatagttatacagttaaataatttcttaattgaaggaatatgtgcattaaaatagcttttaagaaggtaaaggaaacatatatgaaagaagcaaaattccattgttttttgatgcctaggctaggaaatagaatgtttctagttgggactgggcacagcagctcacgcctgtaatcccagcactttgggaggccaaggtgggtggatcacctgaggttgagagttcgagaccagcctggccaatatggtgaaaccccacctctactgaaaatacaaaacttagccaggtgtggtggcgcacacctgtaatcccagctactcaggaggctgagacaggagaattgtttgaacctgggaggcaggggctgcagtgagctgagatcacaccactgcattcc

SEQ ID NO: 10941 - DNA, 1323 bp, Homo sapiens
cacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcatta

SEQ ID NO: 10942 - DNA, 1355 bp, Homo sapiens
tatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgcgctaatgattatctgtaagcctttgtggggagggaggcctgcaaggtcatgaaaggcagaagagtctaattgtgcctggatttctccaggacagcagtggcccctcgttttatcattcccagtccattgtcatcacgtcagagaaaaatcttcaggggtgctaatcctgttgcatcagttgatcatactaacgagaacggtaatgcgacaagatacacattgccttcatctgtacattctgtgataccaggcaaattaccaattacacacagctacttatattttatgaagggcattttttagatgacctcatcctctgtgttatttgttgattgggtttgttttctgtttgttggtttgtttgtttcttccacgtaaggaaaagtagtgtaaacagtagcgagaaaatggaaaccacagaggaagatgtattttgcatgtttttcctttcagtgttcttacacgttgtatcactgcattgtggtaatagcttctataaaatctgccatagttggattatgcagctttgcaaaaatttttactagattttgcactaactcatattagctttgtcctaccaacttctggaatttatctaattattgtttttcaaagtttctttccttttaatgtttccctgctatgcaaaacctttcccagacctcagtttcttaaaagaaagatgttgctacagttcccgattctttcttattacaggctcaggtgtacaggttattctgggttaattttatctaatgaagcccattcctttttgtacataaagatgtcacttaaacttatgcttacaaactaaagactaatcgctcaatatgaaaacatgaaaaaatttttgcttaaagtattaagatggaagtagttaaatatgggttattttgtccttttacttttttaaaaaatgttacatattgtatgcactgtgctgatgcaagaattctacatttta

SEQ ID NO: 10943 - DNA, 1188 bp, Homo sapiens
cttctgccattgtttattacagtgaatttttcacctcttctttgtcttttctttgaattggttacatatgctttgtgttttggatagtagtttggcctttgggaataaaagttattttctagttctttttcataaagtaaaccaagaatttaaatagattaaattatttctatgaaactttggaacgatatggatggggaaactatgacttttgagtattgtagttgtaggtttgatttgcattgatggcaatcttcaggaatacttaaggattacattttcttattcccttgccatttggtacagttggtataaattaacctagccactgggctaccgaagtaaggatctaagggctatctgcaggcagtatgagaatcctgctcagactagaggtaattgaagacaggtaccacttttaatctgagacactactagaatgttgaatgggcatggctatttggttgaatctctttatactttctttttacctttataacagcaccaaataatacagagcagttattttgattcttgtctttcagagtctctggacaagtgggaacgtcttacggtagctgatgcattggaaccagtgcagtttgaagatgggcagaagattgtggtgcagggagaaccaggggatgagttcttcattattttagaggtaaagaactcagaatttaatacttgaattttagaggtaaagaactcagaatttaatactttaaaaagttgtacgctctaagagggaaagagtgggctaattctgaactatagctttagtttttaagaatacctgaccattttattttaaaattatcttttactttgaaatgctgttgtttggttttctgccaggtcactatatttttaaatgagtttgagtcagaattcttgaagggccctagacatgaaaagccaaattctaaaaaccatttaacataacaaactgtgatgattctgcactattcttgttaaaatgcaagtgtttgggctatttggcaaataaggattaaaggtaattatttaaatttgaaaaattactgtgtttgtatatctccacattccatggaaatgtatagcagatactcttgctaagcggatccaagtggcagatttctatgaatgtggctccatagttgctaattgattttatttaaatcaggggtcaggagactgtaaagg

SEQ ID NO: 10944 - DNA, 1516 bp, Homo sapiens
gctacaacgtcggtcagaaaatgaagagtttgttgaagtgggaagattggggccttctgattattttggtatgtatgaattccctcacaataaatacatggtttctttaagtcacctctcagtgagatattgtagtcttccataattttgtcttctcctgaattttattttctaactgcagtcttttttggctctgagagggaaggtgtgagattttgatctttactcatttaatgaaattactgattgtctcatatctattgtcttctttctcagaagtgcactgctttaaggaaatgtttttcatagaagttagcctgttacccatctttgctttctccaggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtga

SEQ ID NO: 10945 - DNA, 1202 bp, Homo sapiens
ttgtgctgtcccacaaaagtgagaggagtacttctctttttttaaatcatcagtaaatttcaattttaaggggcctatgcaaaatgcctcctttctgatgtgattttcttgggttgctggccctagttgaatttatgggccctgaagcctctagtggaaatcttgtcttccctatagaacgagaacagctatgtaatttgcttcaccttctgttaggacttgcaccctctttgccatacagaatgctataaaaaggacagtctgccagtgaccgaagctttctcatttttttttcttccagaacaatagcacacatcttggttaaagctatagtctccttattattcagaaatattctttttcctgctgcaccattaggcaaacatacattatgcttagaatgatacttggaaactccttaacagggcatattgaagtatttgatccagcaacttacctaaaagaatgtttgctcttcacctagggaaataaaacctgaatttcagagccttcaaaatgaaattatccttccaggggaagcacattgccaccaaatacatcactcactacctgttcctggtgactacatagaagatgtgttatttttctgaggtttagaaagtcactgtttacagctatgcaaatattgtactattacagatttttctaatgaagtagtttgaaatcaaggctttagtggaaggtaatcttttcagtttctgacccagatttctttttcaagcaaaactcctctgaaagcctctttgctatagaggtgatgaaggcacttgctagcctaagcagaaacataaagtaaaaaattttgtagtagggaatttttgttggtaagaaatcagtatcatcttgtaacacaaacacgtgttaatagaacttaaaaatactcagcctaattccttgggactttcagtatcttgacatcacttgtattatcatttgaacttggacattgagccctttatttttgggagtttacagttaaattttggaagaattgtgttgtatttctttcttagatgttgtcagtatgaacagaatttttttgtgaacagttaatcttgatgtgctccatagctttctccagtttacacttttgcatttctgagattcagggtctttttcaaggaaggaggctaatgtttaaggcctggaggctgaattcagggagcgtattggcaagttta

SEQ ID NO: 10946 - DNA, 2314 bp, Homo sapiens
gcctctcaaagtgctgggattacaggcttgagccactgctcccagcctattttggtttttatagaagaataactctgaggctagtttaaaaggccagattaagtaatatctttaagaaataatcacccctcttcattactcacacatggaccacagaacgatcataggtgaccttgggcaagtaacttctctttgcctcagtttccccaccagtaaaatgaggataattatgatactgacctcatgaggttgttgtttggggttccatggttcattagtttgcctggcacatagtaagccccagtaaatgttaccattattaatggtagtgtgctttctcttggaattggacattgcagaggatgccttcagcctagccgtggcctcagggatcattaaggtcttacttttcttcctgtccttctcttccagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagagacagacagagtgtgggtttgttcggaggcctctgctgtcaatggattccaggagcaaggccatttgtcgcgctttccaaatttcttaggcatttattttgataagtttatagccatcatgtttctaagagacttggagacaccagcaaactgctagaactcaaactcttcaattactcaaagaaggagccatttcagttaactcaagtgaatgaaagagttttggaatctgctgtgggtccttccctgttgaccatttggtaacttataatctgacaaaaactcttgagctgcaacaggccttgccagagggctcaggatgggaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccatcctcattggttaaaggcacacgtgagactttcagtgggctctgctgagaaggaaggcagcccaggagtcaggtatgcaggcattgcattgtcagtgtctgctctcagagtttacacattcaattgcttccaagggtgaatctcctgctctgtgaatgctatcagaccccaaaggccaaccttgggctgggtctatgtacgttcttccgaagcactgatgatcaaaattgaagacacattcagaggtttgattggttgagattaactggtgtggtggttggtgtatgtatgttttatttttatgtctttgtatgtagttctacataatgcaaattgtgctttctgatggacaagacctcataactgtgattaatatcaataaaaaggggatgttgtggatgacctgtgttacgttcagtacttctcaaagctgcttctttgcaaggatgatcataaaagagctaactaaagttggaactaacacctccctgatccaacactaggagaggcaaaggaaagagctcagatgggaagggctagtcagattcttggttgcaacaacagcat

SEQ ID NO: 10947 - DNA, 1241 bp, Homo sapiens
tgaagatggaatgcaatacattgttttccagcctcggggtcagacgcctctccttcttgcccctcattgtttactaaggacacttggctagtttaagggccagtgagcatgaggagagttggatgcctttttttcccctttggatttatatagaagttccccatttaatcctgcaagaccccggggacgaaaaccatgccaggatgctgtggagaatgggcccctcctcgcttatgtggagtgctctcctgagtgaattaaggaaaaacaaattggtgaccagtcactgtgttcacaggagtgatttcagggagaacagtcctttcccatttccatgctggcattttaattgaatctttttgccatctctatgctaagatgatctctaccccttagggagagcaaatgtacaaaagttaaagctatgctgcagccagggctctggtatctgtgttcagattatgtcctgcatgaattattcatggagaactcaaatgtcttctccatttgggttaatcctcactgccgcccacaacttcctacgtgggatggaaccaggaaataaaaatttcatccaatgtgagcttaaatcatagagggttagaatgacaaatcttcctcctgcctccaatcacacttgtcacttatacccatcagaacgctttaggtatcatcttctctttttactggaacatagtcaaggactgtctggtgacacagtagagcactgtattcaagtaaaacttgtcatttttcatgctgagttctgaacacaaggccacaggccttttctgtctattttcactaacatgactgcgctgggctcctgggttcccctttgaagaccttatgatcctgattgtgagtcttctctagggtataaaagttggccagactttatctgatttttctatcttcagggccatgggctggtggggtcgggggaaggtggtacagtgaattcagtgcctgtcagtcaaaaaaggtaaacattggcaagcccttggatggacattttccaatggagtcacagccgggacggggtcaggggagttggctctgcaggacagcctctgggtactgctgggtcttcttggccaacccagagttaagtggtagcggagtgaggtgtgtgggagggagatgtaacccagtccccctgctcaagaacactaggcacagcctgttaccgggttaccaagcaacccttgtaaccgttgctagctgttcagctgcaaaag

SEQ ID NO: 10948 - DNA, 1184 bp, Homo sapiens
aaataaataaataaataaataacctttggttcctggcctaagttttttattctttaccattctgtccttgaataacgtgtttaagggtttttaaacaattttttatactcatataatgactagttgacttgctgtaaccgtaagtagcaaacatctagcttgttccaaatgaatttaaaagatacaacacataagtaaaatattggtatgtacaaactatgtgcttctcataatctcacatttacctttttcaggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgg

SEQ ID NO: 10949 - DNA, 1228 bp, Homo sapiens
ggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcac

SEQ ID NO: 10950 - DNA, 1221 bp, Homo sapiens
caaaggacattcttgggagatttccagctatcttaacacagggagcccagagcctcgacaaaattgtgcctccaggggcacaattctgaggttcttcagagacacacaggagacacatcacccctaccccacctttaatccagaggctgcagcccctgcagagagaccctggctggccccccgggtagaggcatccaggggacaggcggaacaccccgcacagatgcgctgccggcttcaggctagagtcagtgcagagcccctgggaccgtggatgagggaggggctcctgcttccagtctcccacggagtttcacaaggtgacttctctgtcatctagggcaacacattcctcccagacttcatgagattcaacaagataagggtcccctgcctgaccccaaggtctcaacaccatccctaaggctgagtctggtgccagatcctttgggctggagatgaacaaaaaagcaaaagggctttgctttgcttcctcttttctccaggggtcctgcctccttctggccctccctccccactcccatcaccaggcctggagtctgtgctccccctccgcagaccccagtaattgctgattgagtggctttgaggagctgttaagagaccagggagacgaagcagtcacttgattgcctggcggcctggcaggacagcccctgaaaggccccctttgtgctgggccggtccctgggaagctgcattcaattaccgaggcccgtgagaattgaaagctgcaataggagcccctggtctccccctcgctttcttctcttctcgccctacccccactccgaaaagaaacagatgttcagggagatggaggcgggagcagcagtcgctgatgcaaagccctcctgccttggctttggaaggcggagcgggggaagaggcagaccagactctcgcctgcctggcccctcccgcagcgcgggctctgtttggctccctgctctcccttctagtgccttccatccccgagatgctgcccatagagtgcctgggatcagtaggcattctgcagatagtagctggtaggacggggatggtctagatgagtgggctttgggatctgggcccctaggagggctagagaatcccactccccaccttgcttccagtccggacatgcctctgtcttggagtcgggggttagtgggtggggtatcagctaaccttctactcccattccacctgcctgag

SEQ ID NO: 10951 - DNA, 1158 bp, Homo sapiens
ccggatttgttcctgtggggcagttcagcctttatgtccaggcccagtggctggtctggcccctctgcctctcacaaggcaatgtcagttctgcccccagcttggctgaaggcccaaggctctgccctcagctgcccaccaagagtcactgcttgcctgggctcatcccaaaggaaaacttccaccccaggtctaggtttcttttcaaagacatcccttgggctccccagctattatttctcaggcctctgtccaatgcatagcaagggctcagccgaaacaaccgtatctaggaaactttctgtccgggagtatagagcctatccgtcctccagagaccctagaactatcactatgtctaaaaagggaaagcagtagagaactggatccctgaaccacatcatattggccccagtagagttgcctttatgcatcttgatctgatttacatcgtcagcctagattgagagctgttttaagaagcagcctcataaaatgaaacagaccagtgctttcctggacagtcttttgacagaatgcctcaagaaggcctaccttttgtcccaggaattgtatttctaggaattctgtatctaggcctaccttttgttccaggtacctaggcttaccctttgttcaaggaattctgtgtcctaaggaattgggcggtgatttgcacaaaacgttttgtacaacaaagttaattagtttcattctttttttttcagagatagggtcttgctttgtctcactggaatgcagtgttgcaatcatagatgactctaatctgaaactcctggactcaagcagtcctcccacatcaacttctctagtagctgcgaccacagacatgcaccaccatgcccggctaattttacaatttttttgtagagatggggtctcgggtagggcgcgatcccaacaccttgggaggctgaagtgggcggatcacgaggtcaagagatcgagaccatcctggccaacatggtgaaaccccgtctctactaaaaatacaaaaattagctgggcgtggtagcacgcgcctgtagtcccagctactcgggagggtgagacaggagaattgcttgaacttgggaggcagaggttgcagagtgagccaagatctcatcactgcactccagcctggcgacagagtga

SEQ ID NO: 10952 - DNA, 1167 bp, Homo sapiens
ctgcatcgtgttgtattgggatggggctgaggaacatgctccctccctccctcccataaaatgcctgctcttcacctcccacctttgtggggggcttttgaggacccagctgcgtcaggagttttgcttcaagatgtcagaaagtcaagttcagctaagagacacccaggtccccagcttgccctgagcagcccttcagggcttctggttccttctgccgcccttcctgagaccttagaaaccagaagagccatacagtcagtggaaggcgggggggccctggcctctgcaccgggatcccagtgggaaccttcatgccttatttatttctaatgggtaaaggggttttcttaccaagcatccctgacctcctggagacaccacctgctttccgggcggcactgtgatgggagctggtggcgactgagtccttctgtacgtgcaactgggaaacttttgtcctttgaggctaggcagctccctgccctccgtgtgtgtctgttatctgggggagaggagtgtggaagggttgggggaagagctccagcctgtctgctccccagctctgtagtggcagaccagcgtcacctttgaagtatacgtgagagaaatatatttacaaatgctttattctcttctttaataaaaaatgcaccagtattctaaaagcaaaaatggcccatctctgtgcatctcacacacctgcctcgcgtcacgcccagccatgggagagggtaacatcctgtgtcccacttccctgagactgaacagctccaaatagcaggctctggcagaagtttctatatttattgagggccagctagggatacatggtgaacaagccagcagggcccctcttcccttggagtttatattctggtgtggggagatccacccaaaataaacaaacaaaagatacggcatgatggaaaaatcggggcaagagggtagtgctacctcagctagagcacgtgggcccaacagggtgaaccaagttaaaaaaaaaaaaaaaatcggcctggcgcggtggctcatgcctgtaatcccagccctttggaaggccaaagtggattgctagagcccagaagtttgagaccagcctgggcaacatagcaagaccccctttctacaaaacattttttgaaaattagcagagcatggtggtgt

SEQ ID NO: 10953 - DNA, 1695 bp, Homo sapiens
cttggccaggatggtgaaaccccatctgtactaaaaatacaagaattagccgggcatggcggcaggcgcctgtaatcccagctactagagaggctgaggcaggagaattgcttgaacctgggaagtggaggttgcagtgagccaagactgcaccattgcactccagcctgggcaacagcgagactccgtcaaaaaacaaaacaaaacaaaaaaaaacttcatgtccttatatatttgtgtaatttagaaaagaacataaacaacaaatatgggaaaagatgaacaatggttaattctgtggagtgggagcatggtgggtgattattttgtttatgcttttaggtatgtttccaaccatcaaaccaaaaaaaaaagaaaaagagaaacagatccttgatcttaacaggaaatggctgtcattatgagtattatttctattccctgttttcatagaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaacactgtgtactgtgtcttctttttgagatggtttcagtgttctccctggttagatgcttttctctttgtcactataaatcctgcctactgattggaggagtcatttgaagttaaatagccagatgtgcctgtaattagctacttgggaagccaaggcaagaggatgcttgagcccaggagtttgagactatcctgggcaacatagcgagacctccttaaaaaacaaaatcttaaaacag

SEQ ID NO: 10954 - DNA, 1152 bp, Homo sapiens
ggtcacaggctataatggactacagctggctgtttgaaaaacatagtggaggtgacaaagccatgagattggatgtgatagattacttctggagggaaagagccatcattcttcccagggcagactcaggtgcagaaagaagcctgtgtgtgaagagttaaaaagccaaagtgtggggtgaggggactggcctcctcacgcctcggcagggccaggcctcctgccaatgcttatgggcccggatctcctcccaggtgaccatcttggtgctgcagggccggctggatgaggcccgacagatgctctccaaggaagccgatgccagccccgcctctgcaggcatatgccgaatcatgggggacctgatgaggacaatgcccattcttagtgtacgtgggggtagctttgctctgctgggtcacaggagatgcgtgattcactaaatataaagggtgtggatgggatgacgtctcatggctggtctctcccttagcccgggaacacccagacactgacagagctggagctgaagtggcagcactggcacgaggaatgtgagcggtacctccaggacagcacattcgccaccagccctcacctggagtctctcttgaaggtctgggaagcagttcagattgcatccatgttggcttcctatgggggctgtggcatccagtgcagcagtggcaggagcttggtcctccttggatagggctgtctgtcgctctgccgtgatggcgagagctttcagactagttgaaatccggtgcccttagctgagagcaggagcattatggagaaggtacccctgagaggaggacagagttcagcacaaatgtctctcctcagattatgctgggagacgaagctgccttgttagagcagaaggaacttctgagtaattggtatcatttcctagtgactcggctcttgtactccaatcccacagtaaaacccattgatctgcactactatgcccaggtgagtgagctcggggtgggcaagggtgggggtaggagtcctgggggcgccctgatgggtcattctctttgaattcctccctgaggaacaggaagaccctttcctttggcccttagtgaaagaacaaggcaccttctctggggttcgttatacagcagccctgcctgcccc

SEQ ID NO: 10955 - DNA, 1178 bp, Homo sapiens
tgggggaatatgcaggttactcagtgctcttgtttcgccataggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgaaggttgcagcagcagtggttttctttgcttgtcagtccctgctagagcttagttgtatagctgttgccgatgtgcgtgtttcctcctttgtcgttctgcctgtgcgcgtgtattccccttagcgccctctctgggattccagactcacacaggaaacaaacactgcttgatttgaaatgaggtattcgtatacaaagcacactattgcgaagggtatgaaaggaagaacgtccgaacatgggcccctgccccaaccaatgcaggccagggctgggggcagccaagcaaggcaggctctcttccctaggtgattttctcagcagaacagacttatgagttgatgcggtgtctggaggacttgacgtcaagaagacctgtgcatggagaatctgataccgagcagctccaggtcattttcacttttgggttgatggttccacatggaggtgggaaaaggctccctctatctcaggcttccccttccctccagaaacactggctcctatggacacatgtgcctctgttccccttaacctgtgtaattcacacaccaccttcttttaggagaaaatcagggattctagtgttctcatctctacattttgttctttgctgttcatcatttccagtatggccctttggtattgctttcttttacatcgataatttgctggaagctactatgaatgttaagtgccctctacctttggattagctagacccttcgggagtgtgaaagggctccttcctgctcttagctcatgctggcgctctctgctttgcaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgtaggttcttagagtc

SEQ ID NO: 10956 - DNA, 2241 bp, Homo sapiens
gtcccagcctgaggccccagctgccccagattaggacgtcaggcccaccacctcccagctggaagtgttttgactgtaggattgacacatccctttgctgccttaggttaagtgtctgagcatggttgggggttgcggggaaaagggaccattcctctagcacagagagggtagcagaatagagggcgtcctgccaaggggccgcctgggctggatctcacttgctgccctctgtcacaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtgggggtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgtacttggaatcttcctagtatagacgccattcaccctgatggaggaaaaggtaccacctatgaattctagatatacatgaggacagcctatgatagaactgcccaaggtttttgttaaaagtgcgggttcctgtacgcttatattttaagggaactaaataaccaaaatgttaagtgttccagaagaggtgaggcaagatttcagaagcacaagtataccaccaag

SEQ ID NO: 10957 - DNA, 1178 bp, Homo sapiens
ctgagcagccacgccattgctgtggagggagccttacactttctctgcctccgaactgcacttactaggtcctcattttcttttgccatgtagtacctgggggacagggtgtctgagaaagtgaagaccaaggttattgagctgctgtacagctggaccatggccctgccagaagaagcaaagatcaaagacgcctaccacatgctgaagagacagggtacgtgtctgcctgcccgcagcctccaggcagccctcgaaggctggcccaggcaaggagagaagggaaggtttgggatccccagagtccctcctgaagagaacagcatttgtccccaggcaaggctgagtcggagttggatgggataaggtgtagcagcctgccctccaccctgctaccctttgcaggtcttgatcacagggacgtggcccttggtgtatgaggaggggtgacaaggcaaccacagcctgagtgcacgtgctgccatgtcccctttcaggcatagtgcagtctgacccaccaattcctgtggataggacgctgatcccctctccaccacctcgtcccaaaaaccctgtttttgatgatgaggagaagtccaaggtaaaggacaccctgggcctgggattttctcatacgagagtgggtggcagcaggggaatgtggtttgcactgtgctgcggggagcctctggggtttccctggggtacgggtgctgcctcttcccttcacctctgatttcctcctctctcagcttttagccaagctgctgaaaagcaaaaacccagatgacctgcaggaggccaacaagctcatcaagtccatggtgaaggaagtgagtgggccccggtccttcaggcacggggtggaggagcccatggccacacagcagaagccgctttgccccggacacgggcctgttttgttctcccctgctgccagctgccctacctgtgccccggtggctgagagtgggaggaggagcacaatagcttccgcgggagcacggaagagaggagtgggttgggagcagtgttgtgaaagcagaagtatagactgggccccaggcaccccacactgaaaggagcttccgagcgtctgtacttgtgttgtggggtaaggtgtgacctggtggaagtggaaagacagtcaagtgacgctctctttctcttgaacttct

SEQ ID NO: 10958 - DNA, 2161 bp, Homo sapiens
gggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttcacttggtatctttttttccccttgcctgccttaaaaatttaaaaaccgcatcggggagtcaggaatcttgggtccttatttcagacgtgatcacccagcttacatccccctaggggagcatgtggggctcacaggccttcctgggagcgatgcctgcagttggctgtcaggaactcctggggagcctgttaacaatacagaatcgcaaaccccgccccacatcctcggacattgcctttgaggacacagacacgcccgctgtttctgatgtagagaaaccactgaccacgctttgggaactctggtctagaccaagggctttgggaagataaagagcttggcttatttggttctcctgttttctgtgttaaacaagaagaaggacagaaacacctgtgaagaaacggttttaatatgctgagtaactgaaatatacttgtttgc

SEQ ID NO: 10959 - DNA, 1447 bp, Homo sapiens
gcccctgctgacatggctcctgggctgcctgtccctggtccttgtggtggtgaccaatgagatcgtgaagctacatgagattcggtgagctgtcagcagggcgcctccctctgggctcaggcatgttccctaaacctgttactcccttggcgacactcccccacctttccgctgcccatccctccctcctcctctggtgtcctgccccggcccctggtctaaggatctttgccaacctgtactttaatctcctgccccaccagggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccattta

SEQ ID NO: 10960 - DNA, 1201 bp, Homo sapiens
aattagttaggcgtggtggcgggcacctgtagtcccagctactcaggaggctgaggcaggagaatggcgtgaacccaggaggcggagcttgcagtgagccgagattgtgccactgccctccagcctgggcgacagagcgagattccgtctcaaaaaaaaaaaaaaaaaccagcatggtggtggacgcctgtaatcccagctctactcgggaggctgaggcagaagaattgcctgaggcggaggttgcagtgagccgagatcacaccactgtactccagcctgggcgacagagcaagactccatctcggaggaaaaaaaaaaaaatccagatagggaagtcggtgacctcggcatcctcccaggccatgtctgtgcatctgagagccaagggtttgtcaggacaccgggaggcatgtggggaggggagggcccagcagcagcagcacagggcaggagaactggtttggccatgggcatgaacaaccaccccacgcccccaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggtgtttgagccgggctgggtgggtgtcggggccccgggcactgcacggacgggaagggtggccaggggtgttgtggccacggccagactggatgggccttaagcggagaactgcgagggagcactagcccctactcccccaggtggggaggcagccttggcagccgccaggccaggccgctagcattgcccccactccccaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggtgagtgaaagggccagaggcctctcccgcccctcccgcccctccctgccctctctgagataccgaggctcccactgctgcct

SEQ ID NO: 10961 - DNA, 1226 bp, Homo sapiens
tcagccccaggagctggatggttcaggtcccatgcagggacgtggacttgtgcctgctcagcgccggcactgttctttcagcatctacgagaagctgatccagttctgtgccattgacgagcttggcaccaactacccaaaggtgcgtctggcacacggggctggagggtgatggggacacccagggtcctttgcttgttccatgggatttgacctgcagccacagaaaggtccacgtggtggcacggctcgttgaaagcacagtccctgtctcttttgtttgagtccctattgttctgaaatagtccaataaagagattccggtggccggcctggtgcctggcccctgactggtggggacatgtgtggacctgctgctcctggggttcgctggatgggggcttcgtgctcccatgttcttcagcacttgccagccgccccttggctaaagaccaaagatgacagccgagccccgggtaaggggaccccagaccaagaagctctatgggaagacttgggccaggaacttgggtttctgagtcatttgtcatctgagtcattcgccttttcctttgcaggatatgtttgatccccatggctggtctgaggactcctactatgaggcattaggtagcctttcgtccctcctcccatataccttgtccgcccacccgactgtccctttatccagtcagttggttatccaggtgacacatatttcagggtctactctatgtcaggccatgttcaagggggctgggtacaggcctgaatgagacagacccacccctgccttaagaggcttatgccacagcaaagaagatggaacgtcacgccagtaacgccagcatcgatgagtgttggtgatgacggagttgctgggtacaggggagctttggcaagcagggtcatctaatctggccaaagggatgggaaggcctcactgacaaaactgtgttcaagctgaggtttgaagaggcagaggggccaggcaggtgtaggcagaatgttctgaggccagtgagaggatggctttttcttaagataccagtttgggagcactgggagaaatgtcaaagggcccaaacccctagaccataggtcttaagcctgcagcccatggcccagatcttggcctgtagaggtgctttgtttggccttcatgaattttgtcatcttttaatttgaattcattgccaacattttatataatctctgattccagc

SEQ ID NO: 10962 - DNA, 1308 bp, Homo sapiens
ggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggtaggtcgggcgggggaacaatggcccggcggtggccggctttgtgcggcagcgtccgctcactcctcccctgctcgctgcaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggtaagacaaaggcctggagccgggggagggctgggcggtttccgctccccgagtgggattaatagtgcggctctcgtcctcaacaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctacca

SEQ ID NO: 10963 - DNA, 1187 bp, Homo sapiens
ggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgcagtggtagcttgtttacatgggggtgagggggagtgggtcccaaaagagggcctctgaactatgaggtgggccaggagccttgcctcagccatggaaacggctgctgcccacacccctgagctgtggtaaggcagctggagagggctggaaacttcctgggcccatcaggccccaagacagttcaagtgctctccgacctaggcctagcggttgatgacacagggacccttagccttggacacagaggccccccaggccctaggactctttagggctgtgtggtcagcggtgactggcaatagggcccgtaactgtttctcagaggaacagtgtcttc

SEQ ID NO: 10964 - DNA, 1913 bp, Homo sapiens
actcagctggtcggtcacagtggcacctggggcattggctcaaggattagatgaggtgagacatgcgatgggcctggaaaggaccgtgccagcgcgtggcatgtgctcaggaaacctcacctgctgctctcattggtggaactggacccccagcaccagctgccccgagccatgggggcccggggtctcttagctgagctcagggggaggagaacttgtcaccgacaccaggtgtgtttgctctcacagccgaagccaaggccgcagaagcagccgccagcgcctattacaacccaggcaatcctcacaacgtctacatgcccacggtgagagggcttggcagtgccggtgcagccccacagccgcagatgctgggagccgcagggggatgaccgcaccatgttttaaaccttctaatgcaagtctctcctttctcccttctttagagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactggaccctttctggctctgcgtgtggtgacccgggggtctcttccggaaggagagccgtctggccgctgagggccctggagacttctgggacggttccctcccatgggaggatccccattctcacggcccagccagcctgtctggtccccaagacagctctggcctctggagctggttcttaacggttgtcgctcagcagctgtgtccctcccccactgagtccccagggcctggctgggacagaggtggatgtggcccagagttggccttgaagggaggagttggggctgccaccttgtcccctgctggctcctcgaggaatggcagccctggcctaagtcctggttgctggagggaggaggccgagtcagccctggagca

SEQ ID NO: 10965 - DNA, 1181 bp, Homo sapiens
aggctagaagagaaggaatggcccacagagcaaggacgtaggaggaagaaggagggcaggaaagtctcccccaagcagggaacactatgtgttccaggagccagactcttccccctgctgctctgaggcccctccctcaggggcacctccagagcacacgtatgcccggcctggatacagacgcaccagcagatgtcatcctattgcttctgctttagcgctggccatcgcttgggaagtgttggaggtgtgcatgtggacctgacggctcccacctggccaaggagcttgaaggagaaggtggccgccaaggctgcgtccgtcagctcttgcaccccagcccaagggggtttggagtgtcaccaactcagttgatgacttcagtgcttgaggctctagagttaccccttgtgattgtttctcccatagaatatttgcttctaagaagtgcggtgtggccaggttgtttcaccgacattccctagcccgtggaatggatttgttttcttctctctgtttcactgagaaaaaaagaggggagcttgataaaaaacaacttttaaaacttttcccttcccttcttacatgtctgtagatttctggttagccacttaaaacacactgaaaataacaactcaggtctcataaagaaggaaatcataattttgtgaatgtagtcattctgatttgatatgcaaaattatggaccctaagacctttagttgttgtttcatgtacttattttgcagagccatgtggtcctaaacacacccagctcacacccaaggcagatgcaggcatgagcaggatgacctccccactggcgctccctagcttctgctggttggtcgcagcctcaccagcctggcctctgcccagctctgctcgctctagtattctctgttgagcctgtgtcccacagccctcctcagtgatctgacttgttagggagcagcagacagaaagggctctagggaaacagcaggaaagcgcgagaacacagacatgcccacacaacgtgattcctttcttgtccactctttatccgcttaattattgtcttttttttaacatatgatttgattttttttgtctccatccttaagatttttattttaaggacagcaacgcagagaaaaacacagccagcccctctctaactgcattaactccgttacagg

SEQ ID NO: 10966 - DNA, 1195 bp, Homo sapiens
gtaaatgatgaagacaaccataaacctttggtgaccccaaaataactcttggctcacatgttaaagagctctgctttatatgatcagctgcaggggaagtttgttctttactgtttgcaaacttcagctctgtacacatgatggggccctcttttatttgcggtccctaaactcctgggataccgcatggcctcaccgaaggaaagggcttgcaggtctggttccctgtcgtctgaggtcagatggaaaagccttttgtgattaactcggccacagtgtgtcctttggtatttggaacttcagcggtttttttttttattattaattctccaggttttgaacactgaccgaaataagcttcatataatggaaaaagaagataaatctggctctttgggccccaaattgcatcccagttttcccgctagctgtgaccttgagcaggttgactcagtatgtcggagtttcagtttcctcacttaattaggagagttgtgccttcctgcctcacctcttagggctattcttggcaaactgtaaagcgagggacagctgtgggtctttttaaacacaccaccttctcctgctttgtttctgacacagtttccttacgccgccccacctccccaagaacccgtgaagactctgagaagcctggtcaatatccgaaaggacacactgaggctcgtcaagtaagttcccagaggctggggccaggtcccaggcaccttcctttggggaggctgggggctgggggacagacttcccaaggaactcatacagcagtttccggcagccccagagcttgcttctctgggcctcagacaggagtgcgggcgctactttctgctgagatcaggccgtccacacccatgttgttcagcactggatgcaatcgtctgtgtttgtgaaaaactttcgcttgcctagaaatgcttagtatccttattttatggatattttttaaaagggaagaagaattattaagggaaaatgggaatttttgcagctactccaacaagccaatgtaaaaatgggaaatttgaacttagaatatcaaatcctttattttattgctatattttctttttcttttctttttttttttgagacggagtctcgctctgtcacccaggctggagtgcagtggcgcaatctcggctcactgcacgctccatctccagggttcacgcca

SEQ ID NO: 10967 - DNA, 2100 bp, Homo sapiens
agtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgcatttttttttttttttttttttgtgttggctcattagcaagacaaggtgacaccattaaacctccctctgccattcatctgggctccgttgcctttgtgtccctcacacacacccttcctggggaaggaaagaccttgtttgttgccagggaaggcatgtggcagtgggtcctggctttcctggccaggtgggggccactgtgaacagcacccccacccgcccacactgccctctgcctgccagacctgcttgcatgccttttgtacttcttgtcctggagcagtcctctggcctcctcctggccggtggtgtgcccctcaggagccagcttagagcagcctcccagcagctgtagtctccagagacctacaactgaccagttcagctccttccaggttctgggagagccgacgtcatagcacctggcggtggacaggtgccacaactcctggacgctaagccaaaatggttgcccagtttagacttggatggatccttcc

SEQ ID NO: 10968 - DNA, 1250 bp, Homo sapiens
acaatgggtatcctattcagacagataaccacacggttaagagaacagtggagggatacttggcctctgagggaagtttgaaattcttagggagccaggaacatccaaggaggtggctatgaaggctacattgtggagctgtcataatgactgctttgcatttgggagaaagtgaccaatatctgtgctgtctcccgaggtcagaggtttgtttaatgaagaagtgggttgcatccaggttgactccttgttttctgtcctcctgtgtccagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttctatcttggaaatgttttcctttgagaataccagaacattcccttattgctcttctcctcatggtggtcttgggggaaagcagtgactcctgctgtgcatccttgaccacagagtcgtcgtcccagcagcgtagggagagccattggaaaagtcacccggcatcttctgcagaacctgaggcgtggcctcttgctttttctcccagtttgccgttgctgcttgagtgctcagccaaatcagacagcagcagaaaactctgatttgtcaaatctttttttttttttttttttttgagacagggtctcgctcttgcccatgctggagtgcagtggcgtgatcatggctcacagcagcctcaaccttccaaactcaagcaatcctcctgcctcagcctcccaagtagctgggactacagattcaccccaccatgcccagcttattttttttttattatttttttttgagacagagtctcgctctgttgtccaggctggagtgcagtgatgcgatctcggcttattgtaacctctacctcccaggttcaagcaattttcctgcctcagcctcccg

SEQ ID NO: 10969 - DNA, 1285 bp, Homo sapiens
gcagagtagattcataaggaatgtacttttgtcatgtttatagtaatgttcagttacggtacattttatacaaacccagaaagactgactctatgcttatttaaaaatgcaagaatataatgaaaaagtactaagattcccaattatttgcagttccaagtataattgtgaaatgccatctttcataacttattagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaaggtaagcttttttggctcaatagtacatttggccagtgatgctatatgaaaatctattcataaatcctttctcctcagattttgaagacattttggctacaatatattttttgatgcacaagaatcccaaggtccaattgtggtctacttatcaagttaggaggcaagtatggatgacccttactttttatatgtaacttaagccttactctaccctacccatgcgatacataatttaagaatagaatacatctgaagcaaaacagaaaaggcatgactttaaaagaacaactttttttttttaagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagtacttggattgttccttagtcattaaataggatataaattaggttgagaagggggtatcacaacctcaagaaaagtgccacttaaagcattgcttttaggtgttcaactggcatttccactttaacttaggaaatgataggcactaaacattccacttccatactatgcagtcagccacaatcacaaa

SEQ ID NO: 10970 - DNA, 1825 bp, Homo sapiens
tttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcagaatatgtctcggtctttttttcccccatttatttgaaggacctattcaattttgtgattgtggctgactgcatagtatggaagtggaatgtttagtgcctatcatttcctaagttaaagtggaaatgccagttgaacacctaaaagcaatgctttaagtggcacttttcttgaggttgtgatacccccttctcaacctaatttatatcctatttaatgactaaggaacaatccaagtacttgtaatacgtattttaatttttgtttcatatgagtttaagtgttgtctaggtgacatcaaaatctaaggcaaacagacttgaccatcttcagacccactgcattctcaagctgaagtggtctgctcatagtttgtgtgccaggttgctcatcagtattgatactgtcccagaacaggttgtaggtataattcagagactgtcctttgcaaaggaaatgaccagcatttcaactgtatgtcttcctggaagggtagattctgctatatcttct

SEQ ID NO: 10971 - DNA, 1112 bp, Homo sapiens
gccctgctgtgtccatcactggttctcaaactttagcatgcagtggaatcttcaggagactttgctaaaacagcttgcttgctccaccccagagtatctgattcagtaatttggggtctgggcccggcattggcatttctaaggagtctcaggtgatgctgactgctcgtctggggactgcactttcaggactgcagctgttaatgaaccagctctgcctggaggctagagcccgcctgcctcatgcctaagtgtgcgtcattctgccttgtggtttctcgtgtggctcgaggccagcatcttgtagttgagctctctttatcctatagtgggggggccctcctgggtctggagctcagcccccatcctttcattctcccttgcttccttcactcatgcactcattcgtaaaacatttgtgcagccggtacgtggtggagcgtcagggcacgatggcccttcctgccctcctgacccgcctccttcctctccgcaggctttttgtcctgggcatcggcttcttcactctctgcttcctgatgacgtctctgggaggccagttctcggcccggcgcctgggggactcgccattcaccatccgcacagaaggtaccttggtggggcaaggggagtgtgagatgagtgagggcgtttgtgggtcaaagaggaagtgcctctgagcctagccctgtacctggctttctggccgccctgtaggtggatgtgagtggagggggcctgggcttgggccgtatgaccctccatgcactttggctctggtctggctgtggtcatcaggtttcctctggcctggattctcaggccaggctagggcctttaagccagggtcttccaggcctcagaagaggctgccagtgttgcttctttagttgggtgtcaggggtgagaggtctctggatatgacacttgtctccttgaggcacacatttccttgcctttggcccaggctgtggccatgtgggaacgggcctggccatgggcttaaatgtcttatctctgagctcttgggacacagctccctcccaggccccatcactccttgcccacacgatatttgcaaggcagtggaatggagatcagagcatgggctt

SEQ ID NO: 10972 - DNA, 1229 bp, Homo sapiens
tggccggtgccccgggggggcggggctcagagctgctgctcctctctgctgaccctctgtgttccgcccacccagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagaggtgagtgctggggaaagccactggcattaagtggggcagggaggggatgaaggggaaccccacccctccctcccaggggctgtgggagcacctgctctgcctgcaggtcccacggccctgagaccctgggagacatcctggtgttccgcaggacatcaccactcctaatccccctcctcctgcccggtcttgggggatgtggcagggaagtgtatttgcatagcgctgtctggccagggcctggctccttctctggtgtttctgctcaggggctgacacgtgttggcttgtggaattgagccacgtctgcacgtggggtcccctctgcctgccgtcctggaaggcttggtttctcttctgaacctgggctccttcttgggtctactttagggtctggagaccagtaagacatggaggatgaaggggcgtggttgggtgggtggtgcctgtcccttacccagtgctgggcttttcacggtcccttggatgctgtgggaggtggaagggcagtgattagaggctcccctgagtgtttgagggtaggatgggggtgaggctgagagtgtggggatgtcaagggggtaagagtgtgtgattgggtttatttttaatcactgtttctgtgggatgtaggaatacaggagattcttctctttattaatatttattgtaagatatatgatgcatacaaagtctatgtaaagtatgttgtgaaacacaacagtcaaatcacctcccatgtgtgaccatccatttaagatcatgctgtcaccaaggactctgggtttgcctgagagtgtctgccaatctctctgcctcctccccagatgaaaccttaacttgaactttgtgtatattattcctttgctttttttttttttttaatggagtttctctcttgttccccaggctggagtgcagtggcgtgaccttggctcactgcagcctccgcctcccgggttcaagcgattctcctgcctcagc

SEQ ID NO: 10973 - DNA, 1165 bp, Homo sapiens
aggcatttattctagaaattgaggcctgtctgtaaggaagaggactgggaacgaccggagggccgagttcccgttcctcttcctgcagccgtgctggcagccagcggggtgagtgtgtggtctcctccagctctcctgggagcatggccctattcttagcactgagtttgcttgctaggaaagaacgctggggaagaaagtgccagctttggacgccagccccactttgggtctgcagtgttgaggatacgctgctccctcagtttccctttcggaggctcccccccaacaactgcacgccttgtaccgcacccccacccccgcacccatgctttgtggtagcttcggctaaagagcacccagactgtgcctccatctgcctttggactcccttttcctctgagccagggaccctgagggggcctggcagttctcagctgtagccctgaaccctcgagggcacagggtacatgctggggatgctcaagggcatcgccttttcaggagatgggagctgagggcagggccatcccagtgactgcgtaaagcaactctgggctgcttctgttgggtacagggaggtcagtccatcctgggcaggaagaaaatgctgcaggacggtgtaattctttcctcattagtgatcctaacccctgcttcctaaagcagctcattagatgtccagttcaacctctgagtttcttctttctgcccccatctggtctgtcagggaccagacagtggcctgttgtggtaatgggccatggcagggttgggggctgcccatgatacttgggaaacgggcactggtcaggtttggaggatttcagggccctggggagacagaacgtcccaggctgccccagctgtgtgttccccttgagaggcacccagtgaagttgtggatcctgcctgcacttcagcccctggagtcaaagatctctgactactttgcaaggattctttttaattaggtccctcccacacaagagaaagagagagagaatagtgtgttccacaatttgagcactacctggagagattatttctagccacagaccaaaggcacagagagaaataaaaccagggaatttttagcttagaagagaccgtggagatttgcctgagcacgtgtcccacatgtggaggcggacaccagagcgat

SEQ ID NO: 10974 - DNA, 1196 bp, Homo sapiens
ctcagaagcgctgccctcccaaagacagcccatgggcagtgcctgggaccctgccttttgcatcctggccctatagactgggcacatccaggggtgtcaggctcctgagaagaggggctatgactccctacccaggcagatgcaaattgtatagaggacccaggggacaccagagagggaccccctctccaagcagtgcctcccttctgggtggcagtaatggctacaattcctgagtgctaaccaaggaccatgggtcaggagcttccctacaaccctgagacaattgggctgttgtttttcccactggacagatgaggcagcacagagaggtgaagacactcacctgtggtcacacagcagggcagtgtcctagtccaagtgctaacacacactgtgctactctgactccaccactggctggtgacagtgctcgtggctggggcaacttcagcccagggacacacggggaggttgctgaccctggttcctggtcccctgggggggcaggtgccgaatcagggtcatcgacaccttcgggacggaacctgcgtacaaccacgaggagtacgccacgctgcacggctaccggaccaactggggctactggaacctcaaccccaagcagttcatgaccatgtttcgtgagtgccccacagggcaggggtggggtcggaggtcctcctcatggttctcagaggtgacacgagaggcggccagggtctcgctcctccctctctttccttctccagccagtggggttggtgggacccagcaagcatcgccttctcctgctccataagtgtgtgaaccaggaaggaagcctctggtgctatttggggagcaggaagcatggagggggtgtccagggcggggtgacctccccgactccagcagatgtagccttcaccctccaggagggaggttgggcacacagttccagaacacgggggactccgcggccttccagaaagagaggctttccagagtaagctggagaacttccctgggtagaaaggagcaggcaggcagtgggaacagatgcagtaaagagggatgtgggaagaactggaaggttctggaaatgcaggattgggcttggcttccagggctccaggcaaggaacgtgagtggagctgggcttcagctatttgtttgtttgttttttgagacaggatctcgctctattggtcagg

SEQ ID NO: 10975 - DNA, 1182 bp, Homo sapiens
ccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtg

SEQ ID NO: 10976 - DNA, 1183 bp, Homo sapiens
caacatggagaaaccccgtctttactaaaaatacaaaattagctgggcgtggtggcacatgcctgtaatctcagctactcaagaggctgaggcaggagaattgcttgaacccgggaggcggaggttgcggtgagccgagatcacgccattgcacactccagcctgggctaaaaagagtgaaactccgtctcaaaaaaaaaaaaaaaaaaaaaagaaagggaaagatgaggttaggaagtccttgtgatgtctttgagtaggaggtgaccagcccttggctcagtggtacctgtagacttggaagaatgaggggtggctgggggcccattccccgcagggcagaatcccagggtacctcccatgtcatgttctaggtggaaggtggattttagattttagagagtatctcatggagctcacagttttaaatattcagacttggtaaagtagaataagaactgatgcatatacttttctttgcaggtcagtttctggaagacttgtgtgtgtgatgaatgaatatctggttttgtctctgctgggcctgtgtgcctggaaaggaattgttttggcctaggatcatccaggtttgtttggtttagttcttgaccacatattttttgaatggtgactgcttaagaccctgttgtgtatggctataaatagatacacgccaaggtgaccacatactctgtggttcctgtgcccgccggccatgtgtctgagtgtgtagcctctcatcatctaaaggaactttggctgcagaggggaggcctggtcccatgggaagttttgggagcgcagcagcaggtgggttcaaacgacccagcaagtgcctccttagcacttagaggcggaggccaccacgttgtccacgtggggtttctgatcccagctccccaccagcctgctggacctcgggcaggtccctccctgtttgtacctccattacttcttcagtaagatggggacactgaagatgaccatgcctcccaccagattggtgctttttttgttttaataagggacagagtctcactatgttgcctataggctggtctcaagctcttggcctcagttttcctgcctcagccttcaaatatgctggggtgacaggcatgagccactgcactggcccagattggtacatttgagggttaaatgagcaaatcctataaagcac

SEQ ID NO: 10977 - DNA, 1183 bp, Homo sapiens; identical to SEQ ID NO: 10976

SEQ ID NO: 10978 - DNA, 1460 bp, Homo sapiens
tagggctagtaggtagggttagtaggtagggctagtaggtagggttcgtaggtagggttagtaggtagggctagtaggtagggttcgtaggtagggttcgtaggtagggctagtaggtagggttagtaggtagggctagtaggtagggctagtaggtagggttcgtaggtagggttcgtaggtagggttcgtaggtagggttcgtaggtagggttagtaggtagggttcgtaggtagggctagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaagaaaagaatgtctttttcttattgtgaaacaacagtttcccttgaagagtttgagattcttaggagaatttagagattgaagaaagaagagagcttctgaagccagagtactgatgctctagaagttcaagaagagctttagcttgtgtgggagtgtttcacaggtgagcggtccggcctcagaagagctttagctcatgtgggagtgtttcacaggtgagtggtcgttcaagaagagctttagctcctgtgggattgtttcacaggtgagcggtccggcctcaggtcacagccgtatgtttgctgatgcagaagcgaacccagtgtttgtcctcgcttctgtaagaagacatgatgtggtttttcttaaacgcagccagatctaacatcactgtgatggggcgatccctgctgtgatgtttccgtt

SEQ ID NO: 10979 - DNA, 2483 bp, Homo sapiens
gcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaaggctcctgagtgagaatgttttttctgcccctgaagtgcagttctttgggcctcgggacaggttggggtcagctgcaggtgggcaagaagcatgggcaagaaaaggtaggccgggcgcggtggctcacgcctgtaatcccagcactttgggagactgaggcagttggatcacaaggtgaggaatttgagaccagcctggccaatatggtgaaaccccgtttctactaaaaatacgaaaattagctgggcatggtggtgggcgcctgtagtcccagccactcgggaggctgaggcagaagaatcgcttgaaccccgggaggtagaggttgcagtgagccaagatcatgccactgcactccagcctgggcg

SEQ ID NO: 10980 - DNA, 1120 bp, Homo sapiens
agcgtgcagagagaacccatcaaggaggaggcggggggaacgcgtggctctgcatccaggcaaacctggagttgggccccatctgcccctactctccttcctacacctgtgacacctcaggcaagttgcttcatctccctgagcctcccgtgaaatgcagaagatcccagccacccactgttattgaaggatgggatcgacccattagggcatggagctgtctctgtgtcattttggtgtgccaacccctgccttggctttctgggggctgttttgagtgttctctccccttgaactttgtgtccaactctccccacctcaactcagatgaggctgaaggaaggagagattccattcctacaatagcacaaaaagattttctgtgacatttgaaaacaagaagaagcctacaggtttgttaaccaaattttgaacttggtctggctctgagggctactaatgtgggggccacattggttgcttcctgcagtgagctaagggctatgggcaactctgctcatgaagagcttaaggtggcatctcacttgcaggacagcctccaggtctcactggagtcagggaaagtgatggttgtcctatctccttgttgctttaaatggtagctatctctgaagatggctgaatgtccctgtgcccactggggactttgggaacagaaacatgccaagatgctacaaccggccctgggcacaaagccacctctccagctttccatgcccagcattagtcctggcatggagctgaacacctgtgtctgaggcaggcctaggccctgatgcaaaatgtaccacccacctccttctgccaaatgtcaactcgacccagctgcaaggcagagaaaacttggcagtgttcccaaaggggacaggagattgtctcttttgttaaatgaatggatggatggatggaggatggatggatagatagatagatgggtggatgggtgaaagggtgggtggataggtggttggatggatgggtggatgattggatggatgggtggatggatgggtgggtgggtgggtggtgaatgggtgggtgggtagataactggatgggtggatgggtggttgaatcggtggatgactaggtgaaagaa

SEQ ID NO: 10981 - DNA, 1099 bp, Homo sapiens
agtccatttataaattttcagcttatacataactttttaggaatataattacttaaaaatgtaaaggttacttgtcagaaataactatataaccttgtgcagaaagtgtatatctgaaattgaaactgagaaatgtataatcttagccagtgaacttgtttgaataacccgattaaaataatggtacagtttcctattgtacagatcgtgcatttgaaatgttaatttatttaatgaaaagtaaattatgtaattttaaaaaatctccacctgggatatatataacaaggttttacatgtttaaaacatgctgaaaatccatatcgtttgttccatttttggagttttactaaaaatgaattcttttcttagctttagatgttttcagagaatgaagaagctattgcaggaatggagagctgtttgttaagaatgcattcctcctctgtagccttcaaaagactatagagctgtgtgcagagctagacaatctgggcatccagccataaaacatcactgctgtagcacagatagttgttcgcactctcctgagccctctgtggctgcaaaccacaacagaagtaatggtcttgggaaaggaacactcaatgttattttgaactcttaatattctctgtgtctctctgagttccagctatgcattggaactttggttttctaaaatatagtagtgattaaggatgagcaataatatagcttcttaagtatattcctcttgtaagccagtggatttaaatgtttgctctaggaaataaggggtgtctaggaaataagagttgtctgtcccaccatcttcctctttatttgcctctttgttgcaatacttcttttctgttggagaaccactgccctaagacccatatgatcactgggccacacacagtgcacatggcccaaagagtcatctggaatcttccagatattttgtgggatggattggtctaatttggcccagtttccactttctcatgaacctttttggcataacaaatttttaatttttttgcacaaaaatgaagaagagtgtgactggcatctatttgtataaatccaaatggtttactctgaagaccctctc

SEQ ID NO: 10982 - DNA, 1212 bp, Homo sapiens
ccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggag

SEQ ID NO: 10983 - DNA, 1291 bp, Homo sapiens
agcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaa

SEQ ID NO: 10984 - DNA, 1101 bp, Homo sapiens
atgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcggtgaggaagccctaggactgggggacggggggtgcctgtcttctgctaccctggtaccgtgttcccttcttgtcccagctcccctggggcccccaacccttgccccgctgtgactccaggtggccacagccagctccccgcctccccctcaatgaccctggatgctcatcgtgctggggttcccatggggctggaggcccaagattgctgtggccaaggcccctccctgtttccctcactgcccctgcctggcctcctcctgctctgcccctgtggctgtcaggcctgagggtcgggtggggcgtggggaaagtccctgactcggctggatctccctgtggcagggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacaggtaatgcctccacctcatgacccaggctccgagctccactcatccatccattcatctttcgacccattcattgattcttccctcttcctttcttccttctgtccatctacctgtctgctctcatccactcacctatccaactatccacttacccacccatctacccatccatctacctacccacccatccacccattcatccatccacccacccatccacccactcaattcacccacccatttacccattcagccatccacctacctatctacccactcaattcacccccccatccacccactcaattcacccacccatccatctacccacccattcacccaatcagttcacccac

SEQ ID NO: 10985 - DNA, 1118 bp, Homo sapiens
tgcgggagcccgcgggggtgcagaccttgcgctggcagcggtggcagcgccggcggcagacggtggaaaggcgcctgcgggaggcagcgcagcggctggcccggggccttgggctctgggagggggcgctctacgagatcgggggtaggacccgcgcgacccgcacctccccttgccctctctggagccccactgcccagatcggaaaaaggagagtggcatcatcccacctgccttcacccgggtcccccgaccaatcggcccctcccccctcccaccccttccgcccgcaggcaccgcaaacctcgggcccacgcagcacccccaggtgactgtcagcggtacctccggactcgggcgggtgggagcctggcgggcaccccacgccgtccggtgggcccgcccttggactctcagcgcggccccagccccggccccggcctccctgacccaccctgctctcccactgcaggcctcttcggcacaggaattcggtcctacttcaccttcctccgcttcctgctgctactcaacctgctgagcctgctgctcaccgcaagcttcgtgctgctgcccctggtctggctccgcccccctgacccaggccccaccctgaacttgagtgagtgtgaggcccaccaggggaagtgctccggtgcccacctgcgccatgggggggctggcccagggcccagagcgtggcgacaacgctgggcgtggtcctgccgtgcaggccccggggctctctctccctgacctcgccttgtgtggggcacgcctttggcacatcctcagccccctgcccaggcctccccagggttgggggttatagagcagtagccgcagagcctcacctatgccttggggatccctctctattgacccccttcctcctcaacagccctccagtgccctggtagccgccagtccccgcctggcgttttgaggttccacaatcaactttggcatgttttgactggcagggtgagtgaggtctgtcccggctatggtccagagtctgggagacccagggaactggcttcaggggacacaagtctaagaggacctctgctcctccagggacatttcggctcctcaggggatggtcttacctagac

SEQ ID NO: 10986 - DNA, 1195 bp, Homo sapiens
ccgggcgtggtggtgggcgcctgtagtcccagctactcgggaggctgaggcaggagaatggcgtgaacccaggaggcggagcttgcagtgagccgagattgcaccactgcactccagcctgggcgacagaatgagactccgtctcaaaaaaaaaaaaaaaagaaaaaaatctttacagtggattacataacaattccagtgaaatgaaattacttcaaacagttccttgagaatgttggagggatttgacatgtaattcctttggacatataccatgtaacacttttccaactaattgctaaggaagtccagataaaatagatacattagccacacagatgtggggggagatgtccacagggagagagaaggtgctaagaggtgccatatgggaatgtggcttgggcaaagcactgatgccatcaacttcagacttgacgtcttactcctgaggcagagcagggtgtgcctgtggagggcgtggggaggtggcccgtggggagtggactgccgctttaatcccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaatgtctttagcactaaactacctagtccctcaaagggactctgtgttttcctcaggaagcattttttttttttttctgagatagagtttcactcttgttgcccaggctggagtgcaatggtgcaatcttggctcactgcaacctctgcctctcgggttcaagtgattctcctgcctcagcctcccaagtaactgggattacagggaagtgccaccacacccagctaatttttgtatttttagtagagatggggtttcaccacattgcccaggctggtcttgaactcctgacctcgtgattcgcccaccttggcctcccaaagtgctgggattacaggcgtgaaccaccacgcctggcttttttttttttgttctgagacacagtttcactctgttacccaggctggagtggggtggcctgatctcggatcactgcaacctccgcctcctgggctcaagtgatttgcctgcttcagcctc

SEQ ID NO: 10987 - DNA, 3076 bp, Homo sapiens
gcccttgcagtgcgcgcctgggaaggggctgcccggggccaccctgccggcaggggcgggagccgtgcgggctccgtgaggcgcctggatcggagcgcgggcccaggagagggcccccggggcagtgggtgccccagtcgctcggcgaaggcaggggagccggggcgggccgggcgcgctggagggttccgggcactcaacgcgctcgcgccttcctctccgcagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtaccccacatcctctcctccgggacagtcaccgaaaacacaggttccaaagtctacctggtgcctgagagcccagggcccttcctccgttttaagggggaagcaacatttggaggggatggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatgaaaaacatgacttgagccttttctgcacccctgcccccccgccccccgccccgtgccttgctttctctttcacccacacccacactctgcatcggagaggaggaagagagccgcagagggtggaatcgaatacgtctcagccttacgtcagcacgcctgcctcgtgtgtcactgacaagctaaggcagccacctagacttaccgagaggggtaattcctgcaagtctgattcagatctgaccagaatatgcaaagcaagttcgaaggaagcgcttcaaagggcttgcagggagcaagctgagctgtggtcaaagcttttagaggctccaggctattagaggcgctctggttccttggcagggagtcgttccgagaaagcccagacatggggtcctagtggtgacctatgacctcagtctagccaggttcactggaagtggggggaggggt

SEQ ID NO: 10988 - DNA, 1309 bp, Homo sapiens
gaagagctctcagctctgcccactggaaccaggcaggttctggcgtgagtgttctggggcatttgcattcctgtgattcctgcggctgtggctcccccatggcctttagagagctgctgctggatttgcagcagtgtctgaacttggggaggaggagctgaagttggaacttgttgggagaagagctctctgcgtcttgtggacctagaatggaagcatttcagtgggccgtctggtggaagccctgtccttgtgtcaggggagccctgggcctcagaccccgaccgtgatggtgtgatgctctgcctgccgccatgcactgttcctactgttgtattttgaatttcatctgtaaagagcttgtggagctctgtatctctcttgctgagtgcctacctagcatcctcagctttgccttttggcccagaaagcctaaaatatttaccatctgacccttaaagaaaatgtgtgtggatccctggtctaatgtaacgggccaggcatggatatgagagaaaacaggccatgcttaggccaggatgagagccagcacgctccgagcaggagcggggagactcgagcccagctgtgcttgggagaatgagtccacagagaggctcagggtgtgcgcagggccccccggtgctcctccctccggcagccctgtccagcatgtggcagtgtgactcctttctcccctggagggtgttggcatcaacaggctagactcctgcatgggatggtccttctctttgttctgtagcccagccctgaaaggcactgagtgtctgttcctgcccccagctcagaccatgcaagccagcaaggatgacctgggacagccctccttccctgtttcacttccctgatcagccttgccaaagccttgttgttttatcaatcgtttatcagacaatcaactttggacagttgatattctccatttttgtatcattttcattctagtaatttctattcatatatatatatatatatatatatatatatacacacacacacacacatatgtatgtatatatttttgagatggagtttttgctctcgtcacccaggctggagtgtggtggcacgatctcagctcactgcaacctctgcctccgaggttcaagtgattctccagcctcagctgcccgagtagctggggttacaggcacacaacaccacacctggctaatgtttgtactcttggtagagacagggtttcaccatgttggtcaggctggtctcaaactcctggcctcaggtgatctgcccgctcctgcctccgtaagtgctgtgctgggattat

SEQ ID NO: 10989 - DNA, 1776 bp, Homo sapiens
ggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcc

SEQ ID NO: 10990 - DNA, 1224 bp, Homo sapiens
cttcttagaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtgagccgtctcgtcctcaggctctggggccgccaggggctttgtcctcctcccctcttcaaaagcacagccccccacacacacacctgcacatactcatgcatgcacatgtacacacgcagtcacacatgcactcacgcagttgcacacacacgcatgctcactcccacactgtgtgcactcaggtggctgtgttggacagttgggcccagggctcccctgctgtcctgtggggccggcatctgctctccttctttctccccaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatatt

SEQ ID NO: 10991 - DNA, 1166 bp, Homo sapiens
gcagcactttggcctccccctagtcaggatggagtaggccttaggtgcctgaggttcaggaggaagtgactgagtctgtgcctggggccccagacgctgtctcctcttccttgcagcctcaaggcagcctccccgccgatgcctccccacatccaatgggggtttgttccctttccttgggttcctctggatcagccccgaggaggctccgatgagcccaaatccctgatgcagctcacaggcagctctcggtggaacgggaggaggcttcaagggagcgggtgctgcaggttccctgcatgggataaccgagaacacagaaccttccagaatcctggagagcagggaggggcgggttgctgtgagctggtgggccctggtggtcgcagccccttgcctgctactgcgcacggcctgatggtgtggggctgggcacaccaggccgcatgcgtgtctgacccgcggtcacccggttcccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgt

SEQ ID NO: 10992 - DNA, 1537 bp, Homo sapiens
tagacctcctcgtttgcttctcacggccgccgggtagtcgggaggaggagagcttcacctgtcggcttggagagatccaggtgatgcttcccagaggggctcgggctgggctggctgtttgtccagctggagtgggggtggaggccgccccaggccgcccccttcttgggttcagcggggaactggggtggaggagtcagggaggggaaatgtgtgcgtgggggcaccctctccccgcccccgggcgtccagccgtgctgagccttctctcctgccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccacccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtcc

SEQ ID NO: 10993 - DNA, 1276 bp, Homo sapiens
gtgttccagaaaatacaaagagagagaagagagatcgtgaacagtcccctcctgagaggatggacagaaatcatgaatgccccagggttaggaggaaaatgctggaagaaaggaaggttcaggaccaggaactgcagcccaggcagacttgagaagcccaggagggctccctagccctggaaagccctccctgagctcacagcaggccacctgcttctcggtattctggcagacagtctgccactgccggggttctgggagcaaaacatcctctggtttccctccctcccctctcccacccaggtcatcccccacattccctttttaaagtattcagaattccctctctcagcccattactttctgagccaataagagtagatctattccaacctggagaccaggagagagcagcccagtgggcggacggactctgtgtgtcagggcaatgctgaggcctctggtgtggatctggttacagctccatcggatccggatgatctgatgcacctcttgttgttgttgttgtcgttgttgttgttaagaagtgatggctaaaaggacacacaaggagagggtgggaagagaggagagaaggagtcgtggggagaacacagacgtgtgggaatggctgaggaaggagctgagggcagtgaagggctgggagggacaggctcatattgagggaattgggactggccaggcccagctgcccgccgcacacagagacgaggacgcaggagggggtgaaaggctgggtggatttcttctgtcttggcttcccagatatggcctaaggaggggacttgtcactacatcaggtaggggggaccaggggtccaggtgcatcccccatcagttttgtggatttttcccctccccagcaaagctgtaccctccatgcaaagttctcgtttgcttttattattgagttcacgtcagggttcctggcagcccagcagagctctcctggcgtctcaactccccagagacgtgacctgagacacctcatgtcccaacccaccaaggccctccctgaacagctctcctctggcgctgcaaggagccaggtggtgtggggtccctggcttctgctcggccaccgctgtccctccggcggcacctctgcccctcttggctctgtgctgaggccactcctgtcttgtgactctgtctgtggggctggtttcttctttttcttgtatttgctcttagactaggtgggacacctgagtgacagctggtggcccccctgcctgctgcctgatcaagaggc

SEQ ID NO: 10994 - DNA, 1189 bp, Homo sapiens
cggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgagctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcaacgtggtcaggctcgatgcttgccagccctggaaggtcccgccagggttggggggtcgggtgagcactcagagatctggggaggaagcgaggag

SEQ ID NO: 10995 - DNA, 1249 bp, Homo sapiens
aatgagaggcccgggcttagaagaagccggcgtgtccagaagctgggggggttcccagacccagagccacattccagcctttcatctaagggcagccggggctgggctgacagcactgacggatgtttactgagtttccctggagggttctcccagagttccacccacacgcaacgaaggaggtctgttcccaggaggttctcttagcacatggcctgccagggctcagaactggattccagggcactcagcgttgggacccaggtctcccggactgcagggaccatgttgccgggcagggggtggtggggagaaggccactctggcaggtctccagagaggagctccagggccccccaggaaggagcagttttgccatcttcggcaaagggggtggtggtttttgttcggtgtagttctgtcccctcccgctagcagccaactccactgggactcactgtttcctgcttctgaggttggcgacagtggcctctgattatacttggaaataaaacccccgtgtttacatattcatcgggcttccctctcccccttccaatggcccttcagcgacgaggcctgcaccagcggccagctggtcgttgccagccgagagagccagtacaaggttttccacttccaccacggcggcctggacaagctgtctgacgtgttccagcagtggaaatactgcaccgagatgcagctcaaagaccaggtagcccagcagacggccccagaatgcccagcggttgacactccccaccccccacgggccccatctccctcctgggtcctgtgtctggggtccccgggccccgggggcttacggggtgtgacccacggtagtttttggccgtcagagcagcaactttgggtttgaaacctttgcccagggctttcggtaaagtcagtgccctgcacttgaaaaatcatgttttgacaagacttcctgccatattttgctcaatctacgtacaaatgtaataagagctctttaattatctgtttaaggtactgtatgtgcttattagaaatggggccgattttaaaattcccttccttcccgcagagcctcctgctggcttcccttattacagtagcatggctttttttccccctacattgaacaacctttgatttttgaattaaatgtcagctgcagttttgccctggattcgtgactgctcgcggaggcaatctgacaggctggctccctgctcgcagaacagcgatccctttgtatgtg

SEQ ID NO: 10996 - DNA, 1274 bp, Homo sapiens
cagtgcctctcagcctcttccctgagatccaggggcgcaacaccttcacgccgtcccttttcaggcgtaggtctcgcctcctcttcggcatttcctggaatctgagtttgtggggggccagcaggtgtctttcttctggtttgcatagccctatatggagtctcttttcctacccagaacctttcagagatcgtggccctgcagacacgccttaagcacctgcaggctgtgaaggaggggcgctacgtgttcctgttccgctccaagcagtccctagtgctggagcgccagcgcctggacaagcgactggctctcatcgccaccatcctggaccgcgtgcgggacgagtacccccagttccaggaggccctgcacaaggtcagccagatgatcgccaacaagctcgagtcaccagggccctcctagggagcagcctggactccgccttgcaaggcctccaggaagagatccggaattgtgtttgtcatgagggacttggaatcttttgtgttcctaaaaaccacatgtaccctcagaagggcatcgtttaagagaaataagccagccccacccataggaatctttttagccactcagcaatttaataaaccaggtaaaatcctagcgtttcccatggcatcccatcgcaaagacagagcctgtgactgcagacccacacacccacactcccacactgggcttactcgtccaggtaacactttggtttgcagcactcccaaatctgcacgtgcctctcacaacacaacgctgccacaggtccacaagctggtgggctgagcagaggtgggaaagttaaggcagctccagccagcctggcccgggaggctggtccccccagcacttccctctactaggtgcatctgaaaacccacaaaccaccttctttaccagttttcccatccccaccccttagaactctcaggtcccttttcctgcccccatgtccccatttgagttaaattcagatccacagcttgcaggagaaagtcagtggccccagacacacgtaacagggtgagcactgaaataagagcacgctggggcgtccacaccaagggactacgccccagtctgcccacctatcttttctccatcattaacccagcgctctttctccctggacttccaagtaccaatgaccttggggcttctttgcagtttaaagggaaaatgctctacaaaataatttcactttcaaacatttcagcagaagaataaaatcttttttctgaatatctagtaagcctttctga

SEQ ID NO: 10997 - DNA, 1182 bp, Homo sapiens
gtgattggcccatctgtggggtgcagagccctccaagtgaagaatctgtcccccaaccccagagctgcttcccttccagatgtggtcctgcagccgagccctgcccttagctggaggtcgacaggtgggatcctggatgtctacatcttcctgggcccagagcccaagagcgtggtgcagcagtacctggacgttgtgggtagggcctgctccctggccgcggcccccgccccaaggctccctcctccctccctcatgaagtcggcgttggcctgcaggatacccgttcatgccgccatactggggcctgggcttccacctgtgccgctggggctactcctccaccgctatcacccgccaggtggtggagaacatgaccagggcccacttccccctggtgagttggggtggtggcaggggaggcaaggggctggccgggacgcgtctcctcaggccccagcagacggtcccgtgttgtggctgcaggacgtccagtggaacgacctggactacatggactcccggagggacttcacgttcaacaaggatggcttccgggacttcccggccatggtgcaggagctgcaccagggcggccggcgctacatgatgatcgtggtgtgtgcccccacactgtgggtctttgggaagggggccgcccggtgcccagtggctccttctctgtgcagcgtcatcctcgtgcctgtgtggtcgccgaggatgttttctgagggtctttgtgatatcgagggaatatcaagaagtttgcaggcttggccccagctgtccagggaggtcgggtttgagggtccccagaaatggccgggtgctactcagggttctgtcagatgtaggttacttgaactgccttaaagcaaaaggccaggggcatgataaactgatgtcacctggtcctggaaagtggagggcccggtgggcctgggcatgggtatcgctggaactgtggaggctccgtgtgccttctggccgtgcctctccttctggccggctctgaatccctggaaaggacggcgtgagtgagggcagcttccagccctcatgctggcaccacagagcggagacttcttcccatcagctcccatagaaaagtcccaaagcaggactcttgagtcacccagcacaaagaggcccttccctgagccagtcccacagccagaagga

SEQ ID NO: 10998 - DNA, 1221 bp, Homo sapiens
ggcagcctggtgctgtaccagcctagcattcccgggccctggaggcctccacctccaccagggtggggatgatgacatcacgtgtccttccctttccagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaatgtgagtcctggggctgctcaggctggtgggcaggggccggctcggggttgagaaggggtgaggggacctgggcttgggggtcccacgatggctacctgccactaggacactctagcaggtggcctggggtcctagagtgagcagtggggccgtgcactctgccctttcgtgtacacagagggaggtcacctccctgatgccatcatgagtccctgttctcatgggtgttcctgccccagctgtctgctgacacctccacattctctgccttttcatctctctctgctcggcccagaacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggcaagagggcccagagtggcacagggatcgcgtcccccagccgtggtgcagggggcagaaggtgctgggcgtcctggtgaccgatgccaggaacagaggatgctgggacctcccaagggggtctttggggaggagtgggaagggtcaggccacacaggctgtgcctttcctcctcctgtgtctacacgtgggtgatggggccacaatgacgacctctgagccgtgttgaagcagcaccgcgtttctggcgtgcgttaaggtgacccgcactgagagccggggtccccctgcgcctgccggggaggaaccgggtgcgaagcatcccagggccagacggagctgccccctgagcgccgggcctcgctgctgctgggatctcggggccagatggagccgccttctgagcgctggggtctcactgctgctgggatctcgggctgctccatttgtgctctctcttttccaggtcctggacatctgtgtctcgctgttgatgggagagcagtttc

SEQ ID NO: 10999 - DNA, 1160 bp, Homo sapiens
accgcgcccagctatatttttgtattttttgtagagacggggtttcaccgtgttagccaggatggtctcgatctcctgacctcgtgatccacccgcctcagcctcccaaagtgctgggatgacaggcgtgagccaccgcgcccggcctatatgtaactgttaaatggatctttaaagggaaaagtcagaaacaaggaaaaatgacctatgtctcataacttacctgtttttgcaagccaggtgctttttctgcagagtgggaaaagagactcttttaaattttagcctttggtctactggtggggggcagggaggacatgctttgcgtgggccaggagaagcttaaaattgggggaaacagtaaaacagcaggaaagtaaaaatgatgaaagaattttcatcccatagagcactggagcgctgcatccgaaagctctgaaaccacccccctttgatttttgcaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctagttctctccggattcctcagtgtgctgcacagtccctgctgctcgcaccatcctgcatgtgttccatatggaatcacggccgtgcgcgtgtggcacaagtcacacgggcttgcaggccgttcctcagatggccctgtcatcactgtggctgctggtttgattgattgttaacacttgctcagtaggtgtgcgggaagagactccaaaggttgacagaacatttatggaagcaaaatatgtgaaatggaaaattgtatcaatttatttagctcttttcggcaaaggggaagagattgtgcccccctgtctcccaggaacagtctcgcaggcaatgccacatgaggaagctccctgctggccacggctgccctgctcacatttcctaattggacacttaacccctgta

SEQ ID NO: 11000 - DNA, 1151 bp, Homo sapiens
gtaagtcaagtgcccccatgtgccagccggggcaccaggcactggaggaaacgtggaacagcgagtacaaagcagcactgagtgacagatcatgttgtcagggtggcacctggtccagctggggcgctgggtgggcgactgcgtcctgagccctggggaagcgtggggagaaggctctgcagcgaggcagaggcgggaggccgaccacaggagggagaagggcaagatcctcgctccaaccgtggcccgtgttctctccttttgtccccatagtgtgactccgccaggaacttggaatggctgaagactgtgaatgagagtcatgggtctgtggaacgctcatccctgaccctggccacggccatcaaccaaagaggcatctatgtgatccaggcgcccaaaggtggccaaaaggtgagcggtccccagccctcggcgcagctgcggcccttctgcaggctgctgccagtccaggtcttctggccccaagaaagtgacttctaacctatgctcttcacagatttccccagacacggttctgcacttgatccttcctgagagccctggcagccacgaggagtcacgagagtactctttagaggaggtgaaggagcttttgaacaagttgatgctgatgtctggcaagaaggatcgtaacaacacggaagtggagaggttttcagaggtgagggcgcatctttgcagtggcgctaagctggtggtgtcatctcgtccgtgagggctgtgtactcccaagaaaacggaaaggatttgacttgggatttgactgataagaagggctctgctcttaggcccatggagagtagagttggcacatttgtagggtgcatggaactctagtccgcggccccagagaggtcttaaggcaggcaggcccctgggttagcagtccctccttacgatccgtaggatgaacgctgaagctggcagcctgtccaccgcactgagaaggaggttggtcacccagcaaatagcccttagaaagacacttgaattgcctctctcactctgtaaatcagcaagaatccaaataactaagatttagatggacaaaacagaagtaatcatattgagaatggtgtaccggtctaagtaatagtctctcaattttattataggttctttctcta

SEQ ID NO: 11001 - DNA, 1197 bp, Homo sapiens
caggtcttctgcagtgtgcagaggctcagccaggccttcatcgacctgcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagggcctctgtggggtgtgggagtgaggccgccaggtaccgcatgaggagagtcatggaagagctcccgctgatgctcttatcagagttcagcctggtggacaagctgaggatcatcatggagcagtccatgaggtgccttcctgccttcctgcccgactgcctcgacctagagacccttggccactgtctggctcacctggcagggatgggtgggtctcccgtggagcgttgtctcccgagaggtctgcaggtcggccagcccaacctcgtcgtctgtggccactccgaggtgttgccagccgccctggctgtctacatgcaaaccccaagccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggtaaggagagcggcagggtgggcaggccccgtctccca

SEQ ID NO: 11002 - DNA, 1220 bp, Homo sapiens
atacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttgatgctggccatcggggtgtgttaccatgcctctttagaaaagaaagactcatatcggaaagccatcgccaggttct

SEQ ID NO: 11003 - DNA, 1148 bp, Homo sapiens
gaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttca

SEQ ID NO: 11004 - DNA, 1167 bp, Homo sapiens
tttccgggctcagatccgctttgtaccttgaactgatttccccaaatggctcctaaaacgacggaagagcaaatgaagcattaaagcctgcagggagaagggagcgcagtccctctgtccagcagagaggaagagaccagacttactttgtgcagccgcagcagctgttcagacttatgagcagacaggaactgccagagggcaatggtgtgttttaactggcatctgtttaaggcctgcagaaggaatagaattcctgagtgggggctgaggtctcacacccccactcatgtcgtgcaccagggagcctgagtgctctccacacaggcattcttctcttcgttctgccctgtactaatgtgatctccctccttgtgaaggccatctctgtcctatctaccagttccctcctgcggcacctcacagcccgctcacatcacgctgtttgcaggggcctcatgtactcagtcacatttgggctctatctagactgctggcatttctagcgcgtgtctgtctctactgtccctggtgtgtcctgtttatgctggactgactgggtgagcagttgttcttgtctccccatccttttcaggagcgcctagagtggcactccctgaatgctcctatccctcgcgggaagcaggagaccagggtgaggggctgtgctgatttccttttcggtgtgagacccacctttaacacgtgaatcgtctgatcacccatttgcaggatgtcttgagtatacacattcagctgcatgtttggatccccaccagctgtgctcagaaaccccagagtgacttctacgacagacagcacttcacaggcatcgctgtaggactgcagctgtccactgatggcactaatgaccgagctggggagggagtcctgggaaatgaaaagcaggagagggatgtctgtgggctgggtttctggcatctcaccacctggtaagagagccgagccccttcactgcccaagccacatgcggggggccaactctctaacagctgacacttgggcgcacggtgtgcaggcagttcctggaggccatggagacacacaggtctacctatcagtacccgcatgcggagagcaggaacaaatcggttccatggacttcccgcttcagcaggcatggccatgcatcaacatcattcctaa

SEQ ID NO: 11005 - DNA, 1519 bp, Homo sapiens
tccctcctgccccttgctagggtctgagccaagcccctcgactccctcactgtgttgacacttggcactttgctggccccgagaaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaagcccaatacttagagtcccaattttgtctcatttgccaaaaaaaaaaaaaaaaaaaaagcaaaccccctatggttgatattgttataatgtatatactgtataatatgaaagagaatcgatgtatctcactttttcattatttgctaaccaaagctgtacatttttcatatgatctgcagccttttgggtatcaaatgggtcaaaaccatgggacctgccacctcccatcagcaattctggaaatgcactatttctactggtattcttgctttttttttttttttcattttcttgctgaaatgacatgaattgttgagtttatttttacacagtaaagagtggagaaagactgtggtctcctcaggatgtctcttcttttccgaggcttgccaatgccacctccccctgcagccacccctcttccccagccaggtgcaggtgaccctcacctgcagggggtgtgtgc

SEQ ID NO: 11006 - DNA, 2468 bp, Homo sapiens
cctgcttgtgcggcgatgatctgttttgtgcgtctcttctctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaagggtgaaggcaggccgtcctgggatggtaccctgtgctctcccgtggaggagaggggatggctgaggacactggcccttaccccagggccagacagcatccatccctgctgtttgcatctgagagcagcatggggcctgggaggtcggcctgtgtgcccagctcagctagctctgccccaggacggccctgccctcgaccttcccacctcctcagatcctgcaaggctggggtctgcccctcccttctcacctctggagctgtgctgcactgcttcagcccagagggccctgagagaggagcgtgccacccacagcccgggaagccgggccccagcacccctctcctttggcctccggcagtgcagaccagaggggaccttttaaggaaagaagccgtgtttcgatgaagacctggccacatggggccactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcacgccctgagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgcccggtgcgggctgtgtggggtgctcccctgccagcacctccggccagccccgcccctgccgatctactggaccgcagaccaccttctgcccccgtgggccaggtgggagctgtccgttcaggaccatgagccatcctctgccctgactagcgaggggcagagcacaccccagtgcttacgcctccacccctgcagcct

SEQ ID NO: 11007 - DNA, 1109 bp, Homo sapiens
tggaaagcgctctccctctcgtggcccttttcctcctgcgtccctggcaggtgccatcgcccccgcccccgcttctccagcacttagagcccccgagggagccagatgacccctcctggactcatcccatagctcattagaagttctgagacgcagccagtgaggagtccttgccaaaatgtgctttgctttcctttttaggaaacagagagaggttggaagtttaattggcactgacagccagtccttcccagaggcgtttgcaggcctccgctcggggtggggctggcctctgcctcactggctgggtcccaggcgcctcagggcctcagggctgtccctccagggccaagggataagggcgtgactcattgtcctgccagcccctgcctctccctgggactcctgggctccccaggcctttgatgcttccctggatagagagaaaggcccctgcagccagggagggtgatccccacagccaggcaggcagcaagaggggtcctggcgctgcaggacagcagggagggtggctcggtgccccggtcttcaccgggctgcctgtgtttggctctaggacatccctacgggcgcagacagctgtgtgacgagtctgtcctgtgattcccaccgctcactcatcgtggctggcctcggtgacggctccatccgcgtctacgacagaaggatggcactcagcgaatggtaccttgaccctgtcctctccctccccgagtgctggcagggtaccttccaggtggtagggccgtgtcactgccatttggttgggtccaggtttctcagtgagatgcaaagcttccccaggagcctgcagtggcgtatttaggccagtcctgggctccccaaagccgccaggcccgtcccactgaggcccatcccacaaaggtctgccccacagaggtccaccccacagcctatggaggagcacaggggacaggccatgtgggatgagccagtggactggaggcagaggctgtcggggtgaggcagggccgcagccaggcacctgccacctctgagctcacctgaacagaatactgccactgcctgccacctcctgggtcatgcagcaagtgtctggggaggga

SEQ ID NO: 11008 - DNA, 1862 bp, Homo sapiens
cacggctctctggccttggttgcagcctccccacgtggcttcaggccgttgtttttagattaggattctgcccacctgccgccttgtgttgtgaggctccaggcatgtagctctgctgacacgtgtgacattggatcccagagctgccccgtggggcagtcctgaaaaaaccacgcagggcccggggcagcgccacgcccctcacggagtgcaccatgcatgggccctgcagaggactggtgggaccggcccggcatttccgggcctgaggtgggcgtgggggttcctgagaccccggcaggagctgcctaaggatgcgggttggcctgcgcccccccgccccccgcagtgtctgcccgcacctgaacccctgctcaccccttctctctccttgcagcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccacgaccacgggagtgagagctggtgtggcgaggcccggctctcctgcggtgtggctggtggcctgccgtggccaagagcatcttctgggtggatggaaccctgcctggtcacat

SEQ ID NO: 11009 - DNA, 1163 bp, Homo sapiens
gggctagttggagagccagggactcacctggcgggaggtctggctgtgctacttttccaagtgtttggtgagtactggtggtgtgtgccggtcaagcacaagtggccctttgaccttttgccactcaaaagaaatcaagtcacctgcccagaatgttctacctgttgcttgtttttactggcggctgtgagagctgactcagggtgagagggggcatcgggcgccagggcagtgcagtcgtggcctctgaaaagactcatcaaacggcccctgtggcctcaggacaggcccatgcctgggacacacatgtcctggcctcatttaaacagggacaggagctgggtgtggtggcatgcacctgtagtcccagctacttggacggatcgcttgagcccagcctgggcaacacagccagaccttgtctttaaaaataaataaaaataaacagaggggtgaggccatggccctgagagcccaggaggcctctgtcgggggtctaccattggcctcgcgacaggggtcaacacccatcaccctcgtccacaggtgatgtccattgaagaggtggagaggatcctggacgagacgcaggaggccgtggagtaccagcgggtaggtggcaccctgaccggcctgcccccaactgtgagaacccacaaggccaccctcgagggccaaactgtcccacatcctagagcggccgccttctctcaaggggacgagacccagccacaggccatctccttcctccctgaggggccacctcctcgctgctctcaccaccgcctgtccttttgcagcaaatagacgagctcctggcaggaagcttcactcaggaggatgaagacgccatcctggaggagctgagcgcaatcactcaggtaacggcccccccgggactgagcacagtcactcaggcagcgggacccccagagctcagacccccaggaggccctgcccatggtgatctcgtatgtggtgtcctttaagtaaatagtctgcggtttgtgactggttttcctacctgaggtgactctgttttcagggttgctcacccaacggtctggtgcaggcaggctggccccgtgccctggacagagcgggggtgctgggccttcctggcgcctcggcccctttctgtccccggctgtcacggatgtggt

SEQ ID NO: 11010 - DNA, 1213 bp, Homo sapiens
ccgtggcaccattcagcacaggctctccaacctgcccactgggaagctgactttagaaccgtccatccacgtttgttctgttcctttacccatctttggggctcttctcctctctgagtcccgctgggaggggctgtgctttcctggcccactgtcccgtgtccctggccctgtctgtcagccccattggcttcctgtttgtcacttgcctcccccagagctgggcgtgcccttccctagtgcgaagtccccggaactggcccttgccacccctgtggcctcgtccctctctggaggtctctgcctgtgggtctttggcgtgtcataaacatctctgtttcctccacagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctcctcgctgctcccattagctggtgcaggcttccgttaaggggtccctcccttggcctggcttcccggcgcacctcagcttccctgctggtggggggatccccaggagaccagcatgtgctgaacctctctgtgcctctgcctccgcaccctagacacccacctccagtttgaaggtggcgggccaggggctttcttgctgaattgacgactccgagagccctgactcccgccttgccactcacggctctgtccactagggctcagccctgctgagaaaggacctccgatgcttgggagacgctgctccggcaggtgcagccccggaagtttgtccatgggggtccccgcggctggggctcatggaactgcgagacccgggaccctcctgccctgcgggtccccgagccaccagcagc

SEQ ID NO: 11011 - DNA, 1232 bp, Homo sapiens
gagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagacaaaagaaacctttgtgtgttgtcttctgaggtctgccgatgataaagtcctggacaggaggggctgtgccaggaacccgatgccagcccttcctggggccaggaggaagctgcccctctcctctcctcccc

SEQ ID NO: 11012 - DNA, 1832 bp, Homo sapiens
agaacagcaggtgcagcaaaagcgcttgctggaccagcaggagaagctgctggcggtgatcgaggagcagcacaaggagatccaccagcagaggcaggaggacgaggaggataaacccaggcagggtaggccgggctggcggatggagtggggtggggccaggcagggggtctcctgctgtcctcatgcggctgggtctgaggctcggtggcctctagacctgagcgtgagtctggttttggttcccaatgctgttgttgctggttcttctgagcccctccactggcagcctgtgtacagtgctgtggctaaattgatgaccgacttcatttgcagtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggtt

SEQ ID NO: 11013 - DNA, 1136 bp, Homo sapiens
ggctgagaaaagctgagtgtcgtttggtgtgcatgccaagtgacatagcgagcgccacagaacctgcccgcgccctgtgaactggggcgcgtttgaaatcacatctgttggccaggcacagtggctcacgcctgtaatcccagcactttgggaggctgaggcaggcggatcacagaggtcaggagatcgagaccatcctggctaacacggtgcaaccccgtctctactaaaaatacaaacaattagccgggcgtggctactcggctactcccagctactcgggaggctgaggcaggagaatggcgtgaacctgggaggcggagcttgcagtgagccgagatctcaccattgcactccagcctgggcgacagagtgagactctgtttcaaaaaaaaaaaaaagaaaaaagaaatcacatctgtcattcagcccagccttggggtagtccctggcggcagcccaggtgtgtgccagcttgccctgatggcatttcccgtaccccccgtccctgtgcagcatgatcgggctgatgctgggcacctgcatcgccttctacgtcgtgatcggcgacttggggtccaacttctttgcccggctgttcgggtttcaggtaaggatgtgttcagggttctgggttgttcagatgctgacggctgctctgaggccctctgtgggatcctcccgaggaccgagacctgggtgctggtcgggagaagcttctgtcgagcctgctgtcattctaggggcttggtggagtgcgggggctttgctgggtcacgtctgtgagaggtacacgcgaggaagcaagccaggcagagtctgacaccatgtagatgaggggcgggtgggggagcctcagacccgggcacagtgcagagcaagtctctgccagcccgggctgcccattggagggcagaggcggccaggccctcaggcatccccggcctccatggtcacccagagcttctgggggctgtggactcagcacttcttgcagggaccttggggtagcctcctccgtgcttgccccccaccacagagaggcccacctgacgggcccacacacctttccctcgctgccggggagcagagcccctcactgggcagggcaggcatcacggcacgttagggtgcta

SEQ ID NO: 11014 - DNA, 2117 bp, Homo sapiens
tcccggcatttcctccctgaagcctccaggtttctcatttggtttctgcctgcgttcttttcttttctccacacatcacactggcatgcagcatgttgtggcgtgtgagcatggggtggccgtgggtctctgtccctgactaagccgccccttgtcccttctcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtaggtgttgtgagctaaaggtttctactcttacatcctcggtgacacagcatcactaagggagggctctgtcccctaggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaaggtgagtcgaggggttggtggccctctgcctggctcgggagagctgactggggggcgctctgtgagctgaagccgtgcctggctgtctttgcagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaatgaatggctcctgtttggggaagtagcaagtgggctgggaaagacagaccaacctggaagtattgggtagtcttgggggtgggggcggtgggtgctgctcagcttggcttcgtgggctggtgagaaaacggcttaacaataaactgagcagttcgatttcttccaaatcgaaagtgcaagaacaaggcagcctagtgggtttgggtgttggagataactgaagcaacatcataagcaggctgggagggaagtcctgagacggctttttccattatttaggaaaaactagatgactt

SEQ ID NO: 11015 - DNA, 2437 bp, Homo sapiens
aaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggccgatgctgccaccacccagccttctctttattttcagtgctttttgtttggcctccctgcccccatgtttttctggctgggagctcttggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcatggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggag

SEQ ID NO: 11016 - DNA, 1200 bp, Homo sapiens
gcctgaagagtgagtgggggctgacctgggggcagggctgggccggcaggccgggcctcatgggcaggaggggcctgtgcccaccacctaccgcgttgtcccctggcagccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggcgtggcctcttggtggtctgtcaggcctctgcccctgcggcacacatgcacagccagctcccgggcagggctggaaaccccagatcatggcgaaggcttctcaagcccagaaattctcagtctaagccactgggcgtgctcaggtctcctagggcaggtggtggcagggagggcattctggagggagaggctgggc

SEQ ID NO: 11017 - DNA, 1189 bp, Homo sapiens
tccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctgtccttgcctcgggtttatgatctcaccaagcccggagagctgggctggaatgcggacgccaaggccatctgccaggccttagtggggttactggtgctgagaggcctcgcccctgggacgaggtgcagatgcagaaacaggccccagtctccccagcagagctgtgcaggcttgcgattcccggggaggatgccttccctgcctgtaggctgctttacctggactctgatggggcttctgtgattctggaccctggatgtggacacgggtggagccacccagccccatgtgatgctcagactcctggtcattccctcccatccccgccgtggagtgacgagaaatcaggtggactcaggcttcaaggatgggtgagaggaacagggggccctgcttatcactaacccttcacacgataaagggcagggctgggcgcagggacgcgcgcctggaatcccagtgctggggcaacacggggagaccccgtctc

SEQ ID NO: 11018 - DNA, 1629 bp, Homo sapiens
cagggctggggcttcgcgcagggctgctgggcagtcattgagggggaggtccccccaacaggcgacctggagagcttcaagaagcagtcgtttgtgctgaaggagggtgtggagtaccggataaaaatctctttccgggtaagctacaggctgctgtggccagggaatggaggcggggctggggctggggtccggaccgaccttccctgatcctcgcttcgggtcctgcaggttaaccgagagatagtgtccggcatgaagtacatccagcatacgtacaggaaaggcgtcaagagtgagtggggccccgggcagggcagagggggccgcttgggtgcgtgctgccaggcggggaagcggggccgctgaccgccctcttccttgtgccgcagttgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcactcaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgag

SEQ ID NO: 11019 - DNA, 1228 bp, Homo sapiens
aggtggagaccaaaaaaccaacccgcagctcgtctgcagcggctgccgcccgccgaagccgcgcccgccggaccccaccgcgagccgagcgcacagtcctgggcgggagcggaaacaaggactcccagcagctcccaggcacccgccgcgcccgtagcgcccccagcgcccccagccctggccgatcgggcggagcgtgcggggagggaggggcgcgtaggctccgcctccaacggccgccgccccaccccctgcgccctcgcaccttcgccaacctaatcacgcaccgccctacccgcccttccgttggcagcgccggcgtccgcgcgggaaggtataaaaacgaccacagtcgcggcccgactccctcaacagcgcccgccgagtctcgcacgccagtgcgcacgcgcctccccgcctcaccccgtcccgcgcgcgcagccgtccgccagcggccaatcagcagccgctccgaggccgtggcaccggaaggcctcacgcggcgccggaagtgacgtgccggcgtgctgacgcgcgggctcgagccgatgcccgattccgcgcccgccatggccgacaaaatggacatgtctctggacgacatcattaaactgaaccggagccagcgaggcggccggggcgggggccggggccgcggccgggccggctcccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcagggtgagtgcggaggccggccgcgccggagagtgggagggggccagccggggctggggccggggccgctcgcggcggagacccgggccggcgggtggataaggctggtggagcggccgcccggaggtccggagggtgcgtgtgggcgcggagggggtggtgggcgggagcgaggtcgttctttcggggtccggtcccggaggctgagacccttcccagctctttgtttgttccggacgttggggcctcgtggcaggagaggaggggacgctgggcgcggcacaggcggcgggaagttagtctaagggaactgaagttgtgcggccgcggtgggaccgtgcggcctcgggctggggcagctgcagcgccggagggagcgctggcggccccgtttcggccggatcctctcaggccgggaagaggaa

SEQ ID NO: 11020 - DNA, 3086 bp, Homo sapiens
cccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagagactggcaggtgcttctttggggcgacgcggcgggcggagccggaaggggtgggtgggggcggggcccatcttgcgcatgcgccctgagcgcggcctgccgtgtgaggcggaagcggaagagcaggtctccaggggagcgatggcagccgggggtctgagccgctccgagcgcaaagcggcggagcgggtccggaggttgcgggaggagcagcagagggagcgcctccgccaggtacgccgccgccgctccc

SEQ ID NO: 11021 - DNA, 3086 bp, Homo sapiens; identical to SEQ ID NO: 11020

SEQ ID NO: 11022 - DNA, 1121 bp, Homo sapiens
tgcacgtcgggtctcagtggtcatggggatggaagccaccccagtggctgtcggggtgaatggaggcccctggagatggcagcgggttaagcacgagcacggaattctccctcccaaaacggaactcagacaacagtgacggagcctaagagcaaagccaaagccacgggcaggggtgagcgggacccgaggcaggagatgacggagcctaagagcaaagcgaagccacgggcaggggtgagcgggacccgaggcaggaggtgacagagcctaagagcaaagcgaagccacgggcaggggtgagcgggacccgaggcaggagatgacggagcctgagagcaaagcgaagccacgggcaggggtgagcgggacccgagccaggagtggcgccgggcagggaggcaggcagccccaggcgctgtgtgggcactgggtgagaagcagggatcccggcgccctggctctgtgctgcttcctgagacgagagtggcagagggcaagaagaaaaccaaacagcgcggggaacagaagtcaggaaagatgaacgtctggaaggaaatgcccctgggccgggcggtgcccccgggcgtgaacagaatccagtgctcccacaggcacaggtgcttggtgagggccgtcctccctggctgtgctgtcagtcctcagatggggatggaggtaaggaaatggcccagagtggcctggggctgccactggggaggggccgagggtgtctggagaggtggggccggcattgtggtagcataagcctcttcaacagactttgtaaacctcgtgtgaaacttagtttaagaaacaacaggcttggccaggcgtggtggttctggaagtggctttggagctggctttggtggtggctgtgggggtgggtttgggcgctttggaggaggttgcagtgagccgagatcgcaccattgcactctagcctgggtgacaagagcaaaactccatctcaaaaaaacaaaaaaacaaaagaaacaacaaggctgggcacggtggctcacacctgtaatcgcagcactttgggaggctgaggcgggtggatcacgaggtcaggagttcgagaccagcctggccaatatggtgaaactccatctcta

SEQ ID NO: 11023 - DNA, 1164 bp, Homo sapiens
tggcttggggcttggggtggtcccatggagggcgctggtcccaggacgccctggccttgcttacaggggtagggctggtgtcagacaggaagctgggcgatgggctcatgggggccgggcaggcagagcctgtctgagggtggagctggggcctggccctgggggtgtagctgccttcacagcaggggggtgctctgcccacacccggcccctgagccccccgccctccctgcaggcgaacctcttcccggccgctctggtgcacttgggagccgaggagccggcaggtgagtgtcagtggttggggccagtgtcggagtccagccagcctgtccctggacctcagagccagctgcccgggagggcgttcggtctggggcctcctttgggtctgagagggagatctgcggcccccagtaaccacctccccgagagaggactgggacagccacctgctggccacccccctcccagagctgagtgctggtgggcagatgctgggtggatggtgagtggacccctcctcagaggctcagggtgagcttgggcctccctgcaggtgtctacctggagcctggcctgctggagcatgccatctccccatctgcggccgatgtgctggtggccaggtaagtgccggtgggtctgggggcacctcccgtggcggcactcaccactctgtgtcttcgcctccccacaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccgggtactgcggctgggtggaaggtggggtgctgtggccgggtggagggcgggggtccgggtgctgtggcagggtcagtgggctggggggctaggtgctgtggccggcagggccgagtgcttcagccgggctggtgggcgggtggccgggtggtgagagcccggggtgtgtggtcaccctgatgtgtctgcactacagccagcaagaggtgagagctgccagcctgaggtgcccactccgccagccacaggaccacctcctctgccagcaggaataaagacttgtgcatccctc

SEQ ID NO: 11024 - DNA, 2953 bp, Homo sapiens
gggccgggcctagaccctgggaggcggggcgggtgggcgtggggctcgccgtcggggtcggggtccggcgcacctgctggcgggcccgggagatccaggtgcgcagcagcagccgcaggcgcggcccgtggttcttccgggtggtcttgacggcgatgaagacgtcgtcaggccgcaggctgggggcagcgggccgggacgggggcgcgcgcggggccggggcgggggtccgggccggggcgggcgcgcggggcagcggcagcggcagtaacagcagcgcggccagggccgcggccagcgcgaggcaggcccggcacagcgccccacgcgcgcggctcatgcggccgccgggacccccggcgctgcgagcggagaacctggccggagccgtgggtgggcggcggcccctttaagaacgcagcggccccgccccgccccgcgccccggaagcgacggcttcgctgccccggaagtggacggcacgccgcggcggggtgggtgcaagatgccgctgccggttcaggtgtttaacttgcaggtaacgagccgaggccgccccgggcctccgcgcccccgcgccccccgccactggggccgggctgaggtcgagcaggggcgcggggcctgcgccaggagtcggtcgggcacgctccgtgccgggcctccgcgggcagcgcgcgtcgggggctgcagggccgagggcgcgtctccgccgtggctgcgcgctgcgatcgggggccgccgggccgcgcccgccccgcctcccctcccagcagctcacgggagaggttcccggccgccccgacgctaacgctctttctcccttcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgaggtaccttccaggacagggacccccgagcgagggaggggggagcagggccccggccgcccctgctgtggctgggcccctgctgctctgctggccgaggacagggactcagtgccaagcgcaggaggggagggagccccggtgggcccggggcctgcggagggagccgagctcttggtgcttttcccgaaggagcgcgggaggcccacgggtccggcgagtgcccggcatggcggcttttccagcctgctttgtgttaagccgaggtcctggcttctctgtgtctcccagctgggggccatgaggctccctgagatgactcttttccccttctcccaactccgtggcgtgactctcagcccagtattgctgctccgctgctcaggacagattccgggggctggtcctcctgcctcctggggttgaggtggcgtcccgttcttctccgtggcttggaggaaactacatcaggatggtggctgggaacgtgtaggggccctcagaggcccctgtgtagttggttgtcccctgtctgctttctggctttcagagatgagcggctagaatcaggcgaggggtttctgcttctgagccttagagtcttgtgaggagacccctccctgatgtggtggcacaggagcctgggtgggggcgggggtgactgggagggcacacctgggggacagcagcggcgggagtgtggtccgactggcctggaagatcttgggcagagctgacctcagagaacagtgcgggtctctcgccctcctggggcagtccccaggacgaggtgccaggtgcctggcccatgttgcagggggccgtggagcccatgcagatcgacgtggacccccaggaagacccgcagaatgcacctgacgtcaactacgtggtggagaaccccagcctggtacggagcccagtggggggaccttgggtgtctcagtcctgctgaggggtccagggcacactccccgctgcagcctgcacagcaggtagaatgatcctcctcagtgatcgctgtcgtctttttctgaccccgaaaccatcagcgtttctgattgcgcactcacatgaggcttgtagctcagcttcagatgctgctcatggagaagccagggcaggtctcctccccgctcagcctagcgaccagcagtcactagtgggtgtctatccccgaaagcccccgggtgcagggtcccactcctgaggctcctgcgccaggcccaccccagcggtcttcgtagctcctgggacagcagtcagtctcgtacccccatgcccggttctggttatgggcccagggcgacattctggctaggacagtcaggccccaactcctgaccctcagggcctggggccagggtcctgcctcccatcctgcctgactcttgtctgtgcctgctcccaggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtgaggccaggggcttggcgagaggaagcagaggccaccaagggagcgcgggtgtctgggactgggcccccttcctgtgccctgcatctcccacccctgtgctgggaagtcgggcgggtagagctctcgctctcttttggccagcagtggaagtgccctgtgtgtgtgtggcttctgtgtgtgtgcatgcagggctttgattccaaggggagctgttggagactgtggctcaggggccgcctccctgctggtttccccacccggctgtaggctcctggggcagcagttctctctgtggccctggtgcagactggtccctagaggtggggt

SEQ ID NO: 11025 - DNA, 1388 bp, Homo sapiens
acttgggaggcagagcatgggctcatgggtcaggctgcttctgtaggagggtgaggtctctcacaaatggggtcttaggcattctccgagcgggtgatgggcaggcaggggtggcctggcccttcactgcctgtgacgccaggtctctgctcctcagctgctgtcccccagcaacgtggccatctacggtggcctgtgcgccttggctacctttgaccggcaggagctgcagcgcaatgtcatctccagcaggtaggtgccccggtcctgcagccctgaaggctgtccccgtccctctccgtggctgctgcttcggccttgcatgtcctggccccctggccccagcgttttctcaggtgtttgtctggggactggtgtcccactggccacttggagggaggggcaggcagaggacagagttctgaggggtctgcctcaccagctccttcaagttgttcttggagctggagccacaggtccgagacatcatcttcaaattctacgagtccaagtacgcctcatgtctcaagatgctggacgagatgaaggtgggccccgcctggggtaggggtgaggtggggccctgcctggcctcctgtcctggtcctgaccagccccttccccaggacaacctgctcctggacatgtatctggccccccatgtcaggaccctgtacacccagattcgcaaccgtgccctcatccaggtaagcgtgggggtcaggctggcacacggcaggcgggcatgcagggggctgtggagctgacttccctctgccctgcagtatttcagcccctacgtgtcagccgacatgcataggatggcggcagccttcaataccacggtggccgccctggaggacgagctgacgcagctaatcctggaggggctgatcagtgcccgtgtggactcacacagcaaggtggctgtgggctgcggggcggtgggggcagctgggggtgagcctgggccccgctgagcttgtgcctgcacagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaaggtgggctggcttgagggggggcaggcgcacggcgtgtggggcctggtggctgtgagctgctccttgtctcccctgcagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctg

SEQ ID NO: 11026 - DNA, 1073 bp, Homo sapiens
acccagagtactgggcaggaacggaagggggaagggaaggatgggatgggacgcgaagagcgttaaaggccccccaacttcacccctttaatagccgatcccggccggatgcggttgctcatgcctgtaatcccggcactttgggaggctaaggcgggcagattacctgaggtcgggagttcgagaccagcctgaccaacgtggagaaaccccttctctactaaaaatacaaaaattagccaggcatggtggcactcacctatagtcccacctactcgggaggagaatcgcttgaaccgggtaggtggaggttgcggagggaggagaatcgcttgaaccgggtaggtggaggttgcggtgagctgagatcgccccactccatctagcctgggtaacaaaaatgaaactcgtctcaaaaaaaaaaagcccacccgcagtgtagcacagggcaggccggtgctgtgggtgctgccagcacctgctcagagcccgaccccacaggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtgcgcaaggggcctgacgggaacggggacagggacaggagtggggtgggacggcagctgatcgcatcccctgcaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgt

SEQ ID NO: 11027 - DNA, 1642 bp, Homo sapiens
agtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggtgagcactcccagtaggagccgcgccaggtgtttcccctgctggcatcagggtcttgggacatagcagtcgtgcccctgtgcgcctcagtttccccatctgcagagccagggtgcgggcgcaggtgtcactgtggtggtggtgctttgggagatgcacagcccacgcacccctgggtgtcagccctgccgcatacaggccgtccccatgccccctctggagttgccgacccggcgcatcccttccaggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcggtgcgtgtgggtggccaggcgggagtggggtccccgggcctccccagcccttcctccttgttgtctggaccgtgtcccggcaggcataccgcccttcgtcacgggtgccattctgagcgttcccaccccgactcccacctgacgtagcaccgtggggacctgcgtgcgtgtctgtgtgtccttgcgtgggtgccagggctctgcacccagaccagcctggcatctgcccctgtcttcacagagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgaggtactcccgggccctcctctggaagcggtggtcagtgctggccatcacggggcccgtggctgccgcctgcacatgctgagtgcccggcactgccattgcagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccaggtgagagccaggctggtcctagaggcctacggcaaacgtctgggctccccacctgtgccctggctttgggggaccgtcgcttaggaggccccgccccttccatctgctcagcagtccctccttcctctcagagctaccgggcaaagctgaccccaggctgtgaggctgaggctgagacgg

SEQ ID NO: 11028 - DNA, 1289 bp, Homo sapiens
tgggtgtgggtggacctgtggaaggccctgggtgagcacggcccctgcccgcaggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgaggggaggagtcccggcgcctcgggcaccccaggctctggtccccaggcagtgcctgagccggtgggtgctgcttggacgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggtgagtcggcaggggtgcttgtggaccagcctgggccaggcacagccccgggcccctgagcccttctctgcagcccaccattgtgggctgtcacggtgcctggggtctgtccccctccatcttgtggggggcttgctggatggggctctgcggctgctccccacttccccagcccggcgtgtagggaagagaccgtaccctggcccagtccagcccacagtcctgtgtcccgcaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtgagggaaggccccaaatggggccctcaaaagccccaagaccaagggggggaccctgggtggacgggtgaggccctggagctgcagggagtgctgaggatgcctcccccaggtcttgagagatggcttgctggagaaccagaccccagagttcttccaggacgtctgcaagcccaagtacagcggcaccctgaacctggacaggtgggtaccgcacagccctgctcccgcctctgccgggctctgggctcagggccgtgggagccaaggtggtttgttgacagccctctctggcgtttcctggggatgggacgttgggggctcctggggatgctg

SEQ ID NO: 11029 - DNA, 1153 bp, Homo sapiens
cagggtgggggccgggtgagggccaggcgggcagggtgctgaccaccgcccccacaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaaggtcaggccctgccccacctccaggccccaccccacctcccaacttgccgagtgtggcctgaccctccccgacccgctgtagggcatcctggctgacgaagactcttcccggcctgtgtggctgaaggccatcaactgtgccacctcgggcgtggtgggcttggtgaactgtctccgccgagagcccggcgggaaccgcctccggtaggagcacggcccctcaccacttccccttccccaccagcctccccatccccagcctgagctccccgcctctgcccccaggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggagggtgagcccccgacactgccctgcccctcccgggagactgcacccgaaggccccgcagcagccccacctccctgtttccctagacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccaggtatgggtggcatggggccgtgggagtggactgggccggggagcagagaccccagcagctaggacctgcctgggagcccctcgggagggaagggcaggcggtgaggggctcagtgccgtctcccccagggaagtggacctcccaggacagcctgctaggtatggagttctcgggccgagacgccagcggcaagcgtgtgatgggac

SEQ ID NO: 11030 - DNA, 1198 bp, Homo sapiens
ggcggcagcaggagcagcaggtgcccatcctggagaagttttgcttcactccccacacggaggaggggtgcctgtctgagcgcgctgccctgcaggaggagctgcaactgtgcaagggtgaggtcccagccctgctggcttcggacacctctggcgatgaggagcgatcgcctcccctcacgttgaccccagacttgcttctccacggggccccctttggggtcagcaaccctagcccaaccctccggccggagctcacgatggcggcctccctccctcccccagcccccagccttcctcgtccctggtcactgttcctcagtcttgaaagggtacttgggggcaaagatgacagattcagcctaaggtcacaccttggctaggcacagagtagcccctgcagctgaatgcggcccctcactgcgtccacagtgggcaggagtcagcctcccagtggtgggcagccccttcctcaaccctcagctatttctcatcctgtgggcagagcggggtggtggccccagaaggacagagtgggtctgagagcccatgccaggcagatgccctggggctttgggaacaccaggcctgcctccctccctccccagggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgggtgcctcctgggcagccaggcctctgccccggacatggtaggacccaccctgacatcagttgcaggagacagcacagacacggggcgggccctgggcggtgggtggggccggccagttccctgtgtggttctgtgcacgtgtcctgtgcggtccacacagccaccgtggagggtccgcccgtgggctccaagaggtgcagcctaggcaggaccccagggacaagaccagtggcatccatgcgtgcccatggctggcaccgtcatcaggttgacggggaagc

SEQ ID NO: 11031 - DNA, 1221 bp, Homo sapiens
cttcgacttcagaggtgggtcctgcccagcctcctgcggaggtgggtggccttcaggtccccacatgctgagcagaaaccacgtggcgtgggctcactccgtgcagtgtgtgtccagcctggtggcaggaggtgtgctcaggggtctcgtgtgctcacagccccacctgagccgcagcacccttccttgcagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcgggtgagtgtgcggctgcgcggccagggcaggcgggacagtggcacaggacggccccccgcacagtccccacgctgagcaggatcctgccagctccggggatcccccacccaagcacccaccccacaccccagagctcctcctggtggggtgggggccggcgtggggctgagccccgggcctgaggtgctgctctacccagggaatgggtactgccgctcggagggtgtggtggccgtcctgctgaccaagaagtccctggcccggcgggtgtacgccaccatcctgaacgccggcaccaatacagatggcttcaaggagcaaggtgggctctgccggggttccggggtgctggggggcaggtgggagccggggctggggctgcagcactgagccgagccctccgcaggcgtgaccttcccctcaggggatatccaggagcagctcatccgctcgttgtaccagtcggccggagtggcccctgagtcatttgaatacatcgaagcccacggcacaggcaccaaggtgatgccccccccccccgccccactcaccaccccatgagcctaacctacgcccatgcctggagaggtgacctggccagagcccctcaccccccatgtttcccacaggtgggcgacccccaggagctgaatggcatcacccgagccctgtgcgccacccgccaggagccgctgctcatcggctccaccaagtccaacatggggcacccggagccagcctcggggctggcagccctggccaaggtaggtggggctgggcttgggggtccctcaggctcctgctccctgggactgggttgcgccatgg

SEQ ID NO: 11032 - DNA, 1212 bp, Homo sapiens
gacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagtatgtggttttgctgtgtggcctgtgtcctgactcgcacgtctgctgatggcctggctgttcctaccgtggctctgtcctcgccagctttccctgcagcggcatagcattcgtagcaggggcaggcgctgcatggagggggctgcggggcaggtgcctggaggccgctgtgccagggtggcctctgaaatgtgccagggagcccctacgtggtggttagatgggagctgaggtggaacaagccactttattcactgctgtgtttaagaaacaggaccctcctgccttccctttttcgcccctctgcctggctggcagtgtgcgtggtgtggtcagtgcccagggctggtctttgcaccctgtcctccatccagcccggcccagcgcttgggcttgtcctggacacctaacacccacctgccctcgtggccagcagtggcctgcgtggctgggagcccggtcagaggccgccggggccctcagtaggtgcgtcgtgggcgctggggacggcagcgggtgccctggcgggccgcgtgcagccggagagatgccatgtccctgctcctctgcaatgaaaagcaagcgaaaagtgcacatctcaggtccagctgtccccatctgcccctggccttgcgccagctgggcttgagctcttgcagcccaggctcctgcctgcagcctcagggctgtggaggcctctagcagggctcaggctggcgggcagtgccagcagttgcagggatcaaggtcagactctgcacagctaggcccatgtgtctcggcagagtccaccagtcccacccagcagctgaagggagaaagacgaggaggcagggagcagacgaggaggtggggagcaggcagcccgggcctcagaggacacatggccttcccccgctggcacccccacatcagggccaccaggggactgctcacacccaggggttgccgcctctggacctggctgtccctggttctgctgacctcaggagtgacctgggcttacagaggtactggcagggaggtcatgggccggg

SEQ ID NO: 11033 - DNA, 2615 bp, Homo sapiens
tcttcttgtggggtgcagagcggcggcagtccgctgcccagtcttggggggaggctgtccacagagagctttggaacagagtgaccccaggagaccatcctgttggcctgtggcctccccgtgactgcgttccgtgtgccgttgctctcctcctgtcctgggtgcccacccgtgaggcaggagtggcaaggcgggtgccccgagcacttgagttgccttgtctgcggtcggccgtgcctggaggggcgtctgtgtcctgctcagctgggtggctccacgcttggtgttgggggctcctaagctcttgctgcgccacactctgggcagtctctgccatgccagcttttctagtcgcctctctcttcctgtctcatttatctctgtccttgttttgtgtttcttttcacacttggtctctgcccagccgtcttgtccacgcagcttcgtctgtattaactcctccagccgcagcccactcactccccgccgtcggtgcatggccggcgtccacgctgtgctccctcctcggcggccacgcgcgctcggcggctccttccagcaggggcttgcgcttctgtcgggtctgtgccgctgggagacccgctgcagttttcacactgtgcacactctggaaatgtgttgacaggaactgcttttcatgtcttccctgagaggggtacccattttcaaacaccaggttcctttccaggaagggaggcaggagcacccgtctccgctccactcggatccttcgaccctgccgagcccggctccgcgggcaccttgcttgcatgcctcttcctccttcccgtcttcctgtcactcgttctgctgagcacgtgtcccagccacagaggcccctgtgcgtggcgggggacgcaggcgtctagactggggctaggcggtggcggtgcgtcccctccctgcccagcaccgtcactgtggtatctgcctggccggctcccccagccccatgctgaccttctcctgtgctttggctccgacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggc

SEQ ID NO: 11034 - DNA, 1195 bp, Homo sapiens
atctggatagtgcagcacagatccggctgccggctgctggccacgccaccacacctgcacaggctgttggaggctgcagggtccggaccctgagtgtactcctcgtccgaccaaacgctctcatccccaccccgctttcctccccagctgtcaccatttggggcctgtctttggcctccgatggttcctgtccctctcctctttctgcacgtgttagtgagcatgttcacagagcagcagggggtagctgctgcccatttggaagtttaaggaagttctgagcccacagggagatgccatggcgagtggggttttttcgattgttgggggagctgagaggcctggctctgaccccttgtggggatgatgctgtcatcccatgaggagaaacgtgcagcctgtggggggctttgcaggcagtctcgtcccagtgccctttggtaggtattttctcacgtggccggggcagcctaggacctagggttgctttctgccaaagctggttccattccggcctcacctcctgcctcctcagggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacgggtgagtgcccccctcccagcgctctggggctggctctggggtgacttcttgtgtcttggggttggtggggacaacagggtacttggtggtggacactaagtgccctgtgtcaggcgatgctcgctcctgagggtggatgagccaggctgcccaggcgcctttagaaatgccggcacctgctggtgtgcgtgattcctcccgcatctcacgttcctcccctgtgagccccttgacctcgctcccatgtccctttgtgtccctccggccggatctgagtgttggtggccatcggccacagccaggtcctgactgtccaggcagcccagggtcctctctggccacagcctctcatagaaagccccgagtgagaggcagcagacgggggcggcccactccgtttctctccctgtcctcagctaacacctccccccggcccgtctccggcatggagagagagcggaaagtgagtatgcggctgcaccgcgggg

SEQ ID NO: 11035 - DNA, 1216 bp, Homo sapiens
tgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggact

SEQ ID NO: 11036 - DNA, 1217 bp, Homo sapiens
atggattactttggtttctccgagttccctgctaccccgtttattggaggcccctcaggcagtttcatgtggtgctatcttcataataggtgtgggattggaactttttttttctttttttttttttgagacggagtctcactctgtcacccaggctggagtgcaatggcgcaatctcagctcactgcaacctctgcctcccgggttcaagcgattctcttgccccagcctcccgagtagctgggactaacgcgcacaccaccatgcccagctaatttttgtatttttagtagagatggggtttcactatgttggccaggctggtattgaattcctgacctcctgatccacccgccttggcctcccaaagtgccaggactgcaggcatgagccaccgtgcctggcagattggaacgttttaacatgagaggagcacttccccaatttatcccttcatcctaagattgtgaaaaagtcccaaagagtgggaatggagacagactactgtattttaggtttaaaaagaaaaatccagaaagtgtcctgtgaagagctaggacccccagaggttctaatgcacatgacttgaaggtgatttgatgtgggagtgagggcagagggtggggtggctgtgcctgtggactcctgtggccctggggttgttagggcaggcagtccacagtcccagatccctgcccattttggctctttcttttacccactcatattttccttgaaaatgtttttgccagaacattaataactgtcagccttttagaatcaggagacttacgtacaaatctggattttcagcttttcttagaaaaactgtagtttctgacaacagtaggccccattcctcacagccagtcaccaccctcctcccattcctcacagccagtcaccaccctcctggaccatactcggccctgggccattcctcacagccagtcaccaccctcctcccattcctcacagccagtcaccaccctcctggaccacactcggccctgggccattcctcacagccagtcaccaccctcctggaccatactcagggccctggaggcctggcaacccaggccccaactcaaacttgtacattcagtctttcagtcggactcgcactggggcaagggtgacagacacgagaatggaaaattgagaaggctgcccgcaccagctgggtgggtgcagggggccccagctcatcatca

SEQ ID NO: 11037 - DNA, 2756 bp, Homo sapiens
cggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacctgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttttagagaggaaaaaacctgtattttcctggtgggatgaaatagggatgaaatggctcagaatggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgtggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctcttgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgttttttttttttttttttgccgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaatggaatgcagagtatcattttcattttgattgactgactttttacttcatgctctcttctgagcacaccggaggcctagcgcattggcaagaacttaaccagggagctgcactgaggaccagcactgcaggccctgccagtgggacagcgggttgagcgtgcaggtagaaaaggcgccgtgtcacaggcagtggtaacagggtcttgattgattgatctatgatgtcggagttttaaagttacttggagattgtggctgccactatttcttctgcagactttctctccaacctgagaatgaagatcactgcaaagcatcttgagggacattttctcagaaaatgaaaaagcagctcttggcc

SEQ ID NO: 11038 - DNA, 2393 bp, Homo sapiens
ccacctgggctccatccactgagcgtcagacctaacttcccatggacgtcccagcaccgcgctgtggcaccgatggccgcccagttccccttatttctcctgtgggctcagtgtgtcccgcttacggtctgcacggccatttgggatgtcttcagcccccatccctccagtttcccccaggaaatcacagggacaggtcttccaatgtttgtatagatgaccaagaatgtttcttaaccctgtagccaacaccgggtgattagatgctcacaccaagacagtcaggattcccggccacggtgccgaccgaacgcattcagtggggaccctggggcctttcagggctttcagagcagctgcctggctccaagaggccctttgcagttcagctcagtgggactcgttgcttttaacttgagggaaagaaacacacaggtaaaatggtctccttctatcccagcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaatgggaagtagaattgtgtgttatgaagccaaacactcttccccttgctgtgagaatctggttggagtgtaggcttcagaacagcctgtgggcctgaagaggcgccggcctgtgacaggacaaggtggaagccagggtcactgggtgcggagcctggagcttcactccctgtgtcgggacaggacagcctgccctcctcattccctgtgtcgggacaggacagcctgccctcctcactccctgtgtcgggacggggcggcctgccctcctcactccctgtggcgggacggggcggcctgccctcctcactccctgtggcgggacggggcggcctgccctcctcactccctgtggcgggacggggcggcctgccctcctctctccctgtgtcggggatgggacggcctgccctcctctctccctgtgtcgggacggggcggcctgccctcctctctccctgtgccccaagg

SEQ ID NO: 11039 - DNA, 1197 bp, Homo sapiens
ggtatccgtgccaagccctcaacgggccatcctccttcccgcggcgaccccgcgcatgacaaggccagaccctcccgcgaacgtgctctgcgctcccgcctggcccctccccgccccgcccctccccctcctccccgccccgcctcgctccgcccctccccgcctccgccccgccccgcccgccctgcctctccccgcctttcctcgcctcgccccgccccgccccgccccctcctccccgccccgcctcgctccgcctctccccgcctcatcccgccccgcccgccctgcctctccccgcctcatcccgccccgcccgccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggtgaggaggcgcggccctgtcgccttgcccggccgggccttcccgcagcccggggtccccggctctcaggcctctcctgggcgcccctttccggccaggccttccacccgggaccccggccccgcccgagctcccctccgaagcccccggccccggccctcgccgctgctcccagcccgagccggggtccggaccaggcccgaaccggctcccaccttcctggcctttcgcgctcccccaccccccgggttgtgaccgctcccagccggccgtcccgggccgaggtcgaggtcggtgggagacggcacagaaccccagcctcctgcgcggacgcccctccccgcgcgccacgcccactcgggttccctggctccctgcgggctccacggttatcgggattttccccacagcgtgattgacgccctgcccagaaccccgttttgccccctgttcctttcagggtctttagtaggtagcccgtggctgagctgac

SEQ ID NO: 11040 - DNA, 1417 bp, Homo sapiens
gcgttgatcaatttgctgaggctccattttcctccctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgctggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccactgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccatagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataacgtacaagattgtatatttccctcatttattgtaattcaatatcttagttgtttgctgaaaaacttgtaatattttgtgacaaacaggtacaactagtgtttttgttgttgtttttagagacggtcttgttctgttgcctaagctgcagtgcggtggcatgatcatagctcactgcagcctcaaactcccaggtt

SEQ ID NO: 11041 - DNA, 1135 bp, Homo sapiens
cttgcagtgagcgaggttgcgccactgcactccagcctgggcaacagagcgagactccatctcaaaaaaaaaaaaaggaactcctgacctcaggtgatccgctcgtctcggcctcccaaagtgttgggattacaggtgtgaaccaccacacctggccttttttctttattcttaggtgtttttactttttatctgtttttcactttttcaaaaggccagtttgtatgtggagaggtgccagcgaagagaagctgctatactgatgtattatgatttttctttgttcattttgatgtctctcttgtctgctgagctaagttacggcggtaggtgtgtgtggtggggattccgggggggatgtggcgaggagttggtgaacggcttgcatttctggccctgagggtgatggcatttgaatggctttcataggcattgggtgggcatggagggcagtgactttgagtagattgtggccagtggcctgtgattttcaagcaagactcattcttcccgtggtttaattttttaggcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagaggtaaatatcatgcagataattagctgctaattagtactcactttcatgttcatgctgtcttgatgttagtggtttactcggtaagcttctgatatgtattcaactgctgtttttttcagtggggtaaaatcccataggataacttattttgaaattgtgataattcatgtaggggtcaggttgagttagcaaatctcatttctttgtagatgatgcaaatactctgttgagggtaatcatggcagataaggaagggtttagtggcatggtgagagagaataaggacccattttacatttagttcttaacgttatataaataatagatgctcatttgtaggagaactagaaaataaagataagcaagaaaaatactaaatttaaatttatgaaattctagtgccaagagataagttgtttattttctccgaacttttcctgatgtaaatattatgcatat

SEQ ID NO: 11042 - DNA, 1149 bp, Homo sapiens
gacaatgcaggttccccatgtgggtgtgaagagggctacacgttgctgccttttgaggggcattcgggaggcaggatctgtaggaactggtgaccggtgagacgcagcacctggtgatgaaggggcggtgtgtggcctgggcggtggcagtggtggccgttcaggaaggggctgccaggaggcagagggtcccgaaggccgggtgcttccccagggaaggcgctggtcctgtcgtctgtgtacccatcatctgccttctctcctgactttccctaatcaaagctggacactagctgaggatgttctggactcggggcgtgttttgtggcccacaccaggatcttcctggcagtttgtgctgatggcactgcctccaggttctcccttcttatccggtctctgcaaagtgcatggaattttcacaggcacgctttaagattcaaagtgacactgaatgactggttccagtcatcaggatgctgtgagctacaaagctgatctgaggatgctttgctttgcacaggtaccagcgtggctgccgatctttggctgcaaatctgcagctcctcactcagggtcagagtgagcagaagccactcatcctgaccgaagatgacgacgaagatgacgacgtcccagagggggtggagcgtgtgataggtgcgtggggtctaagcggcggcctctgctcttgggcaccgtcgggccaattcccctctactccaggaccacacttccttcttccttgctggtgccggcactgtctggccacccgtccccttcgctgagtgcacggtcactgcccgtcctctggctcctgaacccaggcctgtccctgaccatggacagtctcttcctgtgtgccgtagaagccctttttcccaccgcctcgcctccttcctgacctgggctgcctgttctgggcagctgggtgtgtcctcaggaaacagttctcccaggaaattgagttggggtccctggggctcaggtctctggctccttggcccctaaaccctgctcagttccttacctcaggagccatttcaaactcccttaaaccacattacaccttgcaggggtctccatccactgccctgttctcctcctgtggggtctcctgctgcacagagacagagccatcagcggagc

SEQ ID NO: 11043 - DNA, 1105 bp, Homo sapiens
aaagagcaaacagtatttacactcggaggaatccacaacaacgtaaattatttgatgccttgtaagaattgaacagtatctaaaagtcttcccatattgtcatcaaattgtgtctcagtggtataaacccattgatgtactgtatattgcctcttaggtagtgctagtttttaaaaggcttactggtgtgattctatattgcagaaataaaatttttaaaactaatgtttggtcttctgttatgttctttcttagcgacttcaggaagaaatcaccaaacagtctccaacgttgcaaagaaatgccttgtatatcaaatctgtaagttatgcagtcctttcgaagccaaattccgcttcactgaaatatttccagttaattaattttatccagtcttaatttttaccaccaaataattaaaacttgtatggtattttgatgtaatgggatttctttacattttgtctcctcagtccaagatcagccggctgcctgcttacttgaccattcagatggttcgatttttttataaagagaaggaatctgtgaatgccaaagttcttaaggttagtaatgaactttactttgtataagaaatgtaattctttgaaggtaattgctaactcacaattgctttcattattcctttaggaatagttaagctttctttgaaatatttaggggagctaatattagacaagtgattcttaactcagaacgtatattagaattatctattgtcttttttatttttaactgtacacacacctggcttctccctcacccccaaacatctgggtaggtcttcggtggggcctaggatattatatttttcaaaagattcatatacaattctgatggctctcctgcactacccagaaatagtgccctagaccacgtcctcagcttcagggatactgattcagtaggcttggagatgggtgtgaggtagggagtgataactctgcactatactctaggtggtttctttctttttttttttgagacggagtctcgctctgtcacccaggctggagtgcagtggcgctatcttggctcactgcaagctctgcctcctgggttcatgccattctccagcctcaac

SEQ ID NO: 11044 - DNA, 2274 bp, Homo sapiens
cggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcaagtagaaatgggagttagttataccagtgttgtttttaactaataaggcta

SEQ ID NO: 11045 - DNA, 1208 bp, Homo sapiens
agggtgtgttcacatatatctcagttgaatgtcacaagaatccctgaagtgattaaaagtcttgagaggtcaggcaatttttgtaaggctagaaggaaaagtgaggttttagacttcatttcttttaaagttggcaaacaaacattttctgtaatggacaagatagatagattagatagatagatagatagatagatgatgattgattgatgattgatagtaaattatttcaggctttgcaggctataaagtgctgcagctccttagctttgctgttgttatagtgtagctggagccatagacagttagttagttagttatgagtgagcacagctgggtgccagtacaattttaatgatcaagactcgtggcaggcagaacaaaccatcatttgttgatcctctgcttgaaagcacgaataagtgagaacagagcagtcatatggtttcagaaagtgttattctgggatttcaggataaattttgtaaaactactaacaaacaacacacaggaaactaatttggtataagaaacgacatatccctaaatagtgcttatttaacttcattataaatacatctacttaacaaaaaaatatattttgtgatcttgaggtcacttcgtttaggtcattatctcaacccaacctccccaaactctggtttgagccaatatgtgttctattgttctcagagcaccagccgactgtacaacaattgttataaaaatgtttattgtttaccaaaaccagtggacctcttatcaaatgctgcttggtaacaaaatctatcacagttttaataaaaagaaaaaaaaaagaagctaactatttgtctcattgtcattagttagactttctgcaaggtcacttaatccagacttattcagtgcattaatcagattctcaggtgttgcatgaactccctcttgatcttgccaggcaaccaggagctgcttagctctcatcttcatgtcttcactgtcacactcaatctgcctaatttctgagtctttcatttccaagtagggagccagaatcttccattgttcacccagcttgttggcaaatacctctatttgttctcctgttacaggtttgtctcgccgaacatcaggacctagaaaatgaagagaatataaattatgcgcaattctaagtatacaacagaaatggaaagctatggggccaataagttttattaaccacc

SEQ ID NO: 11046 - DNA, 1164 bp, Homo sapiens
ctatatgttactgttaaattttggtaacttcatattagaaaatattgttttctataagaaatattgtattccatatttctgatagtcaatttaatatcagagtacatgtttttactgttaatcgagtttagtctgaactcttgcccctaaattaaattgtttctcctctgttggtagataaatcattcatcatgtgaaaacgttttagctattatttctcttgctattgggggagtaactgaaggtaagtatggttccgttttgttttgtttaaagtaatcttggacatgacatgctttatttaaaacgtcttctccccatacttctccacctatctgattttgtttattcttcaagttctgcctgactcccaactttgccaagaagtcccagttgaattagttcactcttatttctcatctctattatgcagtgcacattttggcacttcctttgttctccagttgttttgttcattcagtaaattttcattgagcatctactatgtgcctggtactgagctaggacctggagattcaatggtgaataaaacatattcccctgcttatgtggagctaatggaagaaacagatgtatgcatgccttactatggtgtaagtactatggtcgaagtgggaatgaagtgtagttagagggaatagagccaacatggctctctaaacttcagtctaaaggagtcaggagaggttttagaaaagaacatgagaactagaatgtgaggtatgaagaatttgttagacatactaagaaaggaatagctagagaattgtgtacagcaggaggaggagaggacaatgagaatgatgaggaaagaagcaggttaggtccatttataaagggcactgggtgccatactaaagagcagctgcaggccgggcgcggtggctcacgcctgtaatcccagcactttgggaggctgagacgggcggatcatgaggtcaggagatcgagaccatcctggctaacacgatgaaaccccgtctctactaaaaataaaaaaattagccgggcgcggtgtcgggcgcctgtagtcccagctactcaggaggccgaggcaggagaatggtgtgaacccgggaggcggagcttgcagtgagctgagctcgagccactgcactccagcctgggcaacagagcaagact

SEQ ID NO: 11047 - DNA, 3729 bp, Homo sapiens
cttttgaagacattagtattaaaaataagatataagatggaatgaaaaattagacatgttaaaacatagattagcattttctaagctcttcttgatattctcatgtttaaaatttattttgttgctttgttaaaagaattgtttcactaaataatatactttgaatgagttagtggctagggggtttgttatgttttcctagtggtagttaggaccattgttctttaatgttttaatcttgtgtattaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactcattctttgtggtcaattttcttttttttttgttttgttttgttttttttttgagacggagtctcgctctgtcgcccaggctggagtgcagtggcgcgatcttggctcactgcaagctccgcctcccggggtcacgccattctcctgcctcggccacccgagtagctgggactacaggcgcctgctaccacgcccggctaattttttgtattttttagtagagacggggtttcaccatgttagccaggatggtctcgatctcctgacctcgtgatccgtccgcttcggcctcccaaagtgctgggattacaggcgtgagccaccgcgcccggcctgtggtcaattttctatgtcaagtgagtgacattatttttacaagtattttcttcttcttaaaattataccagcaaatacagttaatgcagaaacctaagtaa

SEQ ID NO: 11048 - DNA, 1205 bp, Homo sapiens
agagtaatgttaggttttattttttttgaggctgagtctcgctctgtttcccaggctggagtgcagtggcacaatcttggctcactgcaacctttgcctcctgggttcaagtgattttcctgcctcagcctcccaagtagctgggactacaggtatgtgccaccacacccagctaatgtttgtatttttaatagagacagggtttcaccgtgttggccaggctgatctcgaactcatgacctcaaatgatccacctgcctcggcctcccaaattaatgggattataggtgtgggccaccgcacccagccagtgttagatttttgaaatctgaatttagcctgcatttttattatgttttctggttttcctgttatcttctagactataccctgttaccatcatctccttctaaaataatatgattttcagtgacacaatttgatattaaccataattgtcttctctctgcttccctttgtatcgtatgtcttgtgttttttgtttttctctttccaagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtaaaattacttttacataaaagcttgtaatgtgttgtgtgttttgcttaactctcttgactatacagggttttccagaataagaattgttttagcttccctcagaagagtcatagagacattgatttcattcataaaatcatgtactgctgtggctttctgatagttatttcctccaagaaagaacttgactaggtatcctttgcattatacatagagcaagtagtagcctctttacacttcttttgacatgacaacaaatatattttaatttctttcctagaaaggccagaggttctcagtcagaggagatattgccctgtaccgccactcaccaggggacatctgacaatgtctacagacttttttggtggttacaacctgggggctactgcttgacatctagtgggtagaggccaggtatactgctgaacctcctacagtgtacagaaatgtgcaggcaaacccccccttccccccacaacagaattatcaggcccaaaatggtagcggtgctgagattgagaaaccct

SEQ ID NO: 11049 - DNA, 1149 bp, Homo sapiens
ggctagagtgcagtggcgcaattttggctcactgcaacctctgcctcctgggttcatgcgatccatctgcctcagcttccttagtagctgagactacaggcatgcaccaccatgcccggctaacttttgtatttttagtagagacagtgtttcactgtattggccaggctagtctcgaactcctgacctcgtgattcatctgcctcaacctcccaaagtgctgggattacagacgtgagacaccttgcccggccttaaaaataaattttacaaaatgtttcacttatgtatatttcatgttttgctgcttatggacaactccctttttgttttgtgcttttagagtaaaactcgaaaggacttctgtttttgtttttctacagtttaaacttaaaacattgatacactatatgccccttaatttttgtaattgatattacagtatagtttattcatttatctagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggtaagaagcctgaatttttgttttctgtcattgtttagctgtggattaaagtgcaacaatttatgataaaatatgtttcaatatttaagagaagtgctgttcactgaagtttggtctaaaatcctttaaaatataaattcctaaaatgtgttatttctttaggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggtatgtattagtatctccttaggtatttgtgttgataatgtttttaagagtcttgatttgtatgcatatagacttatactgttttctaatttaagatttttatgtagacatatttggatagaagaaacctgacactttgtttaatggaatagtgattatccagttattccagaggatagtatgacgt

SEQ ID NO: 11050 - DNA, 1105 bp, Homo sapiens
agcagacactgtcattttattcacaaaaccttattaaattaaacccacacatatttagagttactaataatttgggtatgatatgcctgtgtcttactgaatgcagatgatgatgctgttaccagggaaccacttctattcttcctgtcatagtcttaatatttccatttgtcactgacagaaagggtctgttattttgctgcctttccctctctactgttcctgtgactgtcaggtggagttttgagagacacattgagtagttaatatatagaaatactgtaagagtatattctaacagtaatatttgtgatattactatttaatcaataaaactcttacattttcctgtattttgagccatgttctctagctattctttgtcgtccaaacctatcccagtccattcttactgacacttctgtataatttttctgaacctcatacttttcaattcaaaacacttaatttttttccagatggtattttggcaaaatggggagaaaagatgctgaaagattacttttgaatcctggaaatcaacgaggtattttcttagtaagagagagtgaaacaactaaaggtatgaatattgttatattagtataagtataaaatttcttggggcagtattttgagaaagatatagtgaaagtatttatttttcacccaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacaggtatgtgaatatttcaaaggtaaaaattatttcttcatattctagtttatgaggacaaaatccatatcctcatttctcttaagatttaacacacttatttacacataatacatgcccaataaatgtctgttgtattctaaagggaggaacaggtaatacttagtacttgcattgtgctactcagataatgtgctaatagactctcatcatttgggtccttatatcttactggcatagtatttacattggagttcatttcaccacatgtaccttatgaaaata

SEQ ID NO: 11051 - DNA, 1420 bp, Homo sapiens
gagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaaagatgttttgtcttttgtgtaagggaggttctagaggctagatgtttaattgtaaatatgtgaggaaactcaatgcagaattcaggataaaaattttaaaagcacaggtatttgggaattgaaatgttaagatacccagaacaacattaaatcaatgagtgaacttgtgacagtggtagcatttcaaatttcaaaagacttatcctgtgtgtgtgtgtgtgtgtatatatatatatatatataaatatatatatataaaatattcagcagcaccaagttttataactattgtttgtttgactttattaatactagaatatgtagtctcagccttaattttacatttacattattttgtaattttttattactatttttaaggggttaaagagaacatacattctcacattagtgtactttctggtagaaagttgctgcaaaaacatttgaaatgtatattaacctaatgtatgtcatatatatgtctttgtgtaagttcaagactattgatctgtgaagttattttgtaaggacatacatttggtaagtaagtttgtgtcccaggaaatgtatgtgtttttaaaccctttctaaatatgcaggccattaataaataagattgtttcttccctactgaatagataagtgtttttcttttttaaaattggaagcttcataaaagttatcttgttaaaaaacgatgatgatgttaacctatctatctttataattggaaattatttaaactgtttgttgttacagaagaaacaaaatggtaattacagaattagctgtggggaagattggctcccatggtactacaggttgagtatcccttattcaaaatggttgggacctgaagtgttttggattttggttttttgtggggtttttaaattattattttggaatatttgcattatatttaccaatttagcatccctaatccaaaaatctttcattagaaattggaaatgcttcaatgagcatttcccttatgtgtcatatctgcgctcaaatgttttgaattttggaacatttcttgtttctgacttttagattagggatactcaccccgtaccaatatttgg

SEQ ID NO: 11052 - DNA, 1155 bp, Homo sapiens
cagaatgatagagcaaatgatagagcggagcagtgctgctaagcagctaggcatttttctaggcacttctctgctgaggctgttttaagtaggtggacaccctgtagttcatatatttgcatgtttatagtttgtaacatacagaacatgcttagtcaagtatagatattctttgtaattaaccctcagaatagtatgtattctgatcccttgttctttattctccaggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgataaaatacttacttgtttaaacttcttatttaccaaacttggcttttgttggtttcagtcgtatctcccaaagaaaggtagatgagggaaatcctagaaaatgatatggttgttagctttctcttcctccagttttcctaacaatcctatctcctctactatccattcctcctcctcctcccaaggatatccaattttaactgccctaatcaggttttctgcactttgtcttccaatttttaaaataatttcctgtagaatttgcatatatgatagtttccatagctttaagtccttaagttgacatacctgccaacatttccactttatttaaacttttgtaatttctggtcatttaaaattagaccaggttactgagtataatttcaatttgtcatatttttaaaaaccattttggcttaaaggttctgtggaatgctacc

SEQ ID NO: 11053 - DNA, 1163 bp, Homo sapiens
agcgtgacaagtgtctgtccgcaacgtgtcagatttcgaaactgccttgcaatccagtccggaactcgcagctttagcccgggggaacagacgttcgtttaggctgtgtctcatcattcccccccgccccacccccgccgacctcccactgtcgctgctggaggaagagccccgggaggagaagggtgcgccgcgccgcgcccgcgtgtcaatggcagccgcgcattctggaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtgcgggggaggggcggaggagcggcggggcgggagggggacggggcgggcggctgggggcggaggcaggacctcctgtaccttccctcctcgcctctctcactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtaaggcggccgcgggctgcgcgcaccagaagacgcgagtccggggaaacgtgctggccgggccgcgccgcgcggagt

SEQ ID NO: 11054 - DNA, 1299 bp, Homo sapiens
cttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaattgttgtaattcagagtatttctgttgagggaggtgcttcttaaaaataagtaggaatatagcaccccagtgagcaggaagctgggggggtagggtgcagtgttagggggtgtcaccagctctttgaaaacctgtggacaacaagccagtttgcataaacaggatgtgtgatatttactcttgataggaggcatagcaggcccttagagctttacttaaactgcatggcaaattgaaatgaatcattttagtgtttagctagccactaaatcccttgctgatctgtcctgcgtagtttaaaacgtggccatgttataaagaaaagtcttgaagcatccggttattgctgagttttcagaagaaaacaacgcaagcaatctcttgccctttttccacgttac

SEQ ID NO: 11055 - DNA, 1172 bp, Homo sapiens
catagtcacctgccatgcaagatctcatggggccatgagcgtttctgagagggctttgaatgctgaatgcagcagtcgagcgacttgcacaacttggtgatgtgataaaatgtttaagagatttcatatattagtaagttttctaacatcggtttaagaaacaaattgatgagtggcatctcttaaaagagaaatataaaaaatactcattttactcaaatgaataatatattttggacgatagcaaaaaaaataaaacagatttcttccatgagcttcagccacttgggcgttgttgtaattacttaagagaaagcatgtaattggcagtgacttaacgctggaatgtcatggcatcttgtccaaacgagcattctaacttccaggatactttttttgtgtccttgatctgagaaaatctttcagttgttttcaaatgagtaactaatcaaatgtcttttttgcaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatcc

SEQ ID NO: 11056 - DNA, 1223 bp, Homo sapiens
atagccttcatttctaccctgcaaaataatccagatctgctttctaaaatgaatcagtttctaaagtgaaacatgcaatatttatgctctgactgactcctgaattggaagaggaagaacttctgtttacagaaaactgtattgttatatatgtcaggctgtgtattgtgactatcagcattctggtgcaaatgaacttttctccatcatcgactgtggaaaattgatacttttaaagcatattcttctatgagcacaggtcctcctagtgaagcttagtttgacaaagggtgtcatatgctttcctaacctgatttgtagttaacattcacagagcctacattttctcattacggttatgatgctcagtatctttccaagtgccaggcacgggcttccttttctgatcaaacataccattttttatatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaaggtgctgagggattggacagctctgactttcctcgagactatggatatagtccttctcagattagctggaaatggggacagagttctcatttatcccagatatatacattggcttttttggaatctatagattgagattttgatgaatttatattggttttaatgagacccaaatgactctctcttaacaattcaagcagtagacaaagttgctcacaaatacagaaaacatctttttgtctacttcgcaagtctcaaaacgtgataatatttaagcccatttgtagaagaaatcttgtatatactattattacaccttgatatctatacaaaacatcacttgtattaaaatatatagataactttctggcatttagaattttgttccattcatttaatttgttcatctgagaatttttttttttgcctgaaaacccattaaaagaaaacgtgccttctgtataagtttatgtttattcctacattttattcat

SEQ ID NO: 11057 - DNA, 1148 bp, Homo sapiens
tactagggacttttgtgggtgtatgttttcattattttattgggtgtttacttaggagtgcagttgctggatcttatggcaactctataacttaacattttgaagaagtgtcaaaaggttttccaaagtcactctaccattttatattcccagctccctccacgggtttcatctctgttttctttctttaaacaaggaattggcaaactatggcccatgggccaaatccagcacactgtctgttcttatgaataaagttttattggaatggagatatagccatttgcctgtgtattctctatggctgtgttcgaacaataatggctgagctgagcagctgcaaatgagactctgaggccaaaaagcctaaaatagataccctctgaccctttacagaaaacatttgccaacccctgctttaaacctcttttgccttcatgttgggtcattgccattgttgtctttctagggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggtaagtggggaggtcagagacacccctgagcttcctttgagcttctctggaaaaggagtgttttccattggctccaatgatcagttcttgagcaaagtggtaaggtttaagcagaactccccttgccccttctctccaagccacaccgagttggctgtattatatatgcttggactcacatgggcatctggcttctttttttgtacctctggtaatggtgatatattccagaggcatttctgtgacttcttagaggacaccaaacactgcatacctttatattcccacctcctctgtgggcctcatctctgttttctttctttaaaccaggacttggtaaactatggctcgtgggccaaatctgacacactgcctgttttgtgaataaagttttattggaacagagctgtatccatttgcttatgtattttctatgactatgttcaaccaataaaggctgagttgagtagttgcaaaagagatgctgttgacccctagcttaattctatggtattctt

SEQ ID NO: 11058 - DNA, 1632 bp, Homo sapiens
tttgttgggaactgaccaagataaccttgatttggccaatatcaacctcatgttggagttactagttcagaagaagaaacaactggaagcagaatcacatgcagcccaactacagaatcttatacaattcctcaaggttgcaagaagaaataggagagagcaactgggacacttccagaaggagctaagtgttttggaagaggatattaaaagagtggaagaaatgagtggcttacactctcctgtcagtgaggatagcacagtgcctcaacttgaagctcctcctgcatcacacagtagtattatggattccacagaatatagccaatatccaggtttcagtggcagttcttagacaaagaaacagccttgatataacagcacattaacatcaaaattaaaatggcccactgctcattttgaagacctggagcactgttacttttctacaaggttgtctcgtatctcagatgacagttgaactgcaagccaattggatgaacttcagaaatgcttgtccaaggttactcaatataaatcaatatgaactttagccacattatcatgccctagtgatctctataatgattccaggatagtctctggtattgaatttgaccaggattgtgactattttgcaattgctgaggttacaatgaagattaaagtctatgaatatggcacagtcatccaggatgcagtggatattcattaccgtgtgaatgaaatgacctcaattccaaaatcagctgtatcagttggagtagttaccataagaacctgttagctagcagtgattatgaaggcattgttatcctatgggatggattcacaggacagaggtcaaaggtctaacaggagcgtgagaagaggtgttgaagtgtttcatttgatggatcctaaactcctggctttgggttctgatgatgtaaaagtgaagctgtgatctaccggtctagacaactcagtggcaagcattgaggcaaaggctgatgtgtgctgtgttaaattcagccgctcttccagatgccatttggcttttggctgtgcggatcattgtgtccattactatgatcttcgtagcactaaacagccaatcatggtattcaaaggacgccaaaaagcagtctcttatgcaaagtttgcgagtggtgaggaaattgtctttgcctcaacagacagccagctaacactgtggaatgtagggaaactgtactgcctacattccttcaagggtcatatcaatgaaaagaactttgtaggccttgcttcccgtggagagtatatagcttgtggaagtgagaacaactctctcaacctgtgctataaagcactttctaagactttgctaacttttaagtttgatacagtcaaaagtgttctggacaaagaaggaaaagaagatgatacaaatgaatttgttggtgctgcgtgctggagggcacaaccagatggagagttcaacatgctgattgctgctaacagtgagggtacaattaaggtgctagaattggtacgaagggtttactcaaccctaaatgtacttgatcctgctgatatacctctgcagctgacaatgatagaagaaacagaaaatgtcatgtgatgtctctccccaaagtcatcatgggt

SEQ ID NO: 11059 - DNA, 2131 bp, Homo sapiens
ggtccaagaaactgagtagtcaggagatttgatagaattaaaagcataatttcatgtaattctatttattaatagtgttataaccagtggtagttccaaggctgtcagtacgattttgagatgacttgatttgaaattgtcatgtaacaaaacagtactacatttaaagtgtcttattggaaagtgaaacctccaatttttgtactgtctttcttggtttgttttcaagaacttacttcccttaatgcttttttggaatagatcattttggaaatatttgtgatgtctgtaccatatgtttttaaaatgttgtcgttggagacattatattaaaatgagtagcataactatacctgtttcaaatatccagtcttggatcatgcagagtacagggagttgttaaaccatcaaatgagggttaggctgttattttagtacctgacataaataaagtagggttaaattccgtttagaattgtcaatattttatggctccgtacttcagtatataaaaatgagagataatagagttgcactgtgtgatgaagagaaatcaggtacccataggtgggtaactgagggcttgagtggatggagggtgagatggatgagcaaaggtgtgctttagaatgcagaagaggagagaggaagaaggattttctaagcctggcagcagtggagcagccccccacctctggggagggttccttaggggacttgggaatggatgctgcgagaccttgaccgccatgctaaggagaatggacccgatcctatgggcacctggaaccaaaagactccttagtaaggcattggcacgaaaacagtttggcagagttgcataggatgtttgggaataaggaagagctgcggaggatgcttgggaataaggaagaaaccaggaggcaaggagaccaagcagtttgtttctgtgtcccttaacaaacatgcacttacccgagcacatactccctactctgagtgtggttgaatttctgtcttgctcatttttgtttgcttcacatgtagcctataatacttagagtactggagtactttagtactcagtgcgtgcttctaactgtgggatgttcagagaatgatcatggcccctggcctgctgcagagcgggaagacactgtgagaacgccagccagctccacttcagtttctgcttcagagttgcttttcccctccactcatcagatcgtttgttgagcacctactgtgtgttgggtgttatgctacccagtggggattcagtggtaaacaggacatcgactctgtccagaagtggatcggagcttctgggagctgcgtgaccgcttgtcagggcagtgacagatgtgtatgggtatttgggagcacagtgaaagcgcctccagtcgaggctagtgatgaggcctggtcagagaaggcttcctcgtcattggaatgtttgaagataagtttgttcctctagttcctttagaaaaatgcaaattaaatatggtactgggtgtggtgtagaattgtggttgccttacctgaacgcttaccatttgagcagttagctcccggggttcttcccaggctggtttttctagtttcatcttcatgtagtgcagtgaattccatatagagcaagagtctcttccacagtaggagtttctccctaccctgtcagggctgctcgcgacagccgtctgggaaagaccgtgagcctcacagcatggcccagggaagagtccctgagtgtgcctggaccaagatgggtcactagagtggtagtattgtctaattcctaggctaggagagtgtttccattaagagcctttttatttttatttatttatttatttttgagacagagtcttgctctgtcacccaggctggagtgcagtggtacgatcatggctcactgcagcctcgacctgccaggctcacacaatcttcctgccgcagcctcctgagtagctgggactgcaggtgcacaccaccaagcccttttttgatttttagtagagacaaagtcttgctatgttgtccaggctggtctcaaactcctagtctcaagcacttggcctcccaaagtgctcagattacaggcgtaagccactgctcctgaccagtaagtgcccttttaaagtaa

SEQ ID NO: 11060 - DNA, 1827 bp, Homo sapiens
gtctcttccgggtggcagaggcggaggagaaggtgagtggggaggcaggagaggcaggtgaaacttgtattgaaaagcagctgtgtataagtggacctgtgcagttgaaactcatgttcaagggtcagctgtatgtgtaccttgtaaagttaaaacggatttttttttgtttgtttatacgttagatgcctctggatattttaaggaatgagttgtccaatagtatcctgtcgttacaaccagagcctgagataccgccagaactgcctccaccaagaccacatgtccgatgctgttgatttcctactttggagacaaagtggaaatgattcctggaaaggggaaaaaacgttctattctgcactacaatcattttgacaatttcctttcgcactttgtaatccaagtcagagctatacactaacttgtaaatatgcatatatgcaatcctgggtaagttttggttataagttacctatttccctccaaattattatatttcattcattaccccagtgtctagtgtacatacactgggaaacctagtacttctaatatgaagaatgggagaaatgaaaggtataatgtttcttgaaataaataatataattgtccttattaattatattatgaggacagaagatattctgataagagagaacgtggtgctttgcttaccgttttaaagaaaatttgtaaaactaaagactttttgaaaaaaagctatcttaagtgctttttctttatttacaagacatttcccccagtggtagcatctgaagtattggagtgtttctgccacgaagcaaagctccattcatggccgtcatggaaggttatttattaatgttacataatggtagaatattactagttagagggttggatttgacttggtcctaaggccacagaatctctctcatggcttcctaagggatgtacctttatgcttttaagaactacaaagattcaataaagaaagaaatgtttttgaaactatagaaaaagattttaaaacacgctgctgtcctaaacaaatcctgtttaaaggaattttaaagagatgcattttactatatcaaagaacatacgtgtatttgcctaaacactctgtacctttgtaatgataaaacttcccccttctttacggtgaagcttattctgattaagcctagactgtgttctttttttttttttttttttttttttttttttttttttttttttttggtctgatgatgaatttgtgaactctatctttggtatatcttttattaaactgcactgttttgtttagtcaaggtaattaagtaattatgtatttgaataacttggtgtgtcttgagtgttgtggtatgaaaagcattgtggtctttctacactaatgaagtgcaaataaaattttgtatttatgaatgaagttgagttgccatatttatttatccaattataaattgtatatatgacagtattctccatgagctccacagcttaatccttttgagtgtttagacaggaaaagcatagtcctccactggggaaaagagtttgatgttttctcaaagggctgaacatagagctaccatatgatccagcaatttgacttctaggtttatatctaaaagatcgaaagcagagactcaaacaggtacttgtacaccagtgcccacggcagcattgttcacgagagccgaaaggtggaaaccgccccaatgtccatcagcaaaataatggataaacaaaatgtgtgttctacaaacaatgggatattcatccttaaaaagaaaggaaatgctgtcacatgtgcagcgcggatgaatcttgaag

SEQ ID NO: 11061 - DNA, 1171 bp, Homo sapiens
ggaaaatgtctcatttgtggatagcgtcgcttagtcaatgctgagatgcgtcttgtggaacagaatttttgggacatttgcaggtatgttttagttccagggcaattagcacttgttatcctactgaagtttatgttctttgaaggcagggtccgtatgattcatcttagtacctagattatgccttagagataaaggcttaggtcaatgtttggtttgaattgaaaggttcaattatctgcagagttgattttatttgatcatgtagggagatgttgggagtgggataagttctgagaggccacaatgaataatccagttttttagcttctggttacataagatttgaacagatactcaattatattatctcatatgcaaatttccagaggttctggtgcctgtcacccaggcgtggccatgaggtgatgggtaagcgtgtaggtattcaatatttagtattgaggagcgggtatgaaggagagacatgccatccttttttgatgtacttggctcataaatcttctctgtctgatttgcataggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtgagtgagggggtggtgcgtgcacctcgcaaggctgctgtggaccggctggccacatgcacgttgccctggtgttttttccctgcttgtgtctgtctctacagattgcagcataaacagtcttggtttgctttatggcttatagagtgtgtgtagttatatgactttgacaccccaaggtttacatttgtcataatatgaactttaaaaaaatgatgattatttgtgataacgaagaattaatacctgccaatgggtctgacaattggatagaaattctgcagaaactctgaaagatctgaaatattttttttaaaaatctattgattatcagtgtagtcaaaggccactcttaaaagttgatcatatcacttaacatttttttattgttatttaggtttc

SEQ ID NO: 11062 - DNA, 1205 bp, Homo sapiens
aaactaatttttttttgtttcttttgcttctgtggcaaagcaacaaactgtaggcctttcacaggccccctccacaaagcccctgggcccacctctgctttgtcttggctgtttctctatgtaactcagcggcaccgatgggaagatcggtgtttgatgtttgtgtgcattgggggcgaggtgtgaggggaatcatgaaaaacacgaacatttggtattttcaaataacccttctcccgggctgttctctcctggcaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagt

SEQ ID NO: 11063 - DNA, 1297 bp, Homo sapiens
ctgtggaactgccaatggcttacagaagtggcaattccatatggttcacacctaatacaaatattgatactacatggcctacatgttccaagatctgagtctttgtgataaagttgtttgcatgctctgaggacaaactgctggttgaatgttctcaggtgacaaatggtgtcttctttgggctactgttaccccatccttctggggtcctcaggtaagtcctcctgccgtggaacggtctgtttatatgtgagtgccctgccttcttagggctctgaatctcagttgaaattggggctatgtcacaaagcattaaccggctgtgtctgtattgtctgtttatattacacaccaaatagaaattattctttaagaaccaaaaaaatgctttgaattacgaatagtgaatcctgcaagcaaaaataggttcttgatggaatcccagcattatggcatgaaaacggttttatcagtacaaagtggcgcccaaccccttttgtcctccgtaaagtattcatttagattttctcttcacttggtgtgtttgccaccaaaagagatgatgtgaagggagcacagttgcagggcctcagagcgggcatggagcactcatcggcagcatctaaatgccacgggctcttttttccatttctgttggaattttcctcgttctagattccagtgggattgttctgaattgatgtaatatattcaggccattgcaaccccttcccattgctccatgaattatgcagtagttctcggtatgcgttcccaaatccccaggactacttctgattccaagcccacccagtgcgctgttgcggaatctttccccgaatgttcactcaggcatccacacccaggagtgatgcaggtgacaagaaatctccctttctcactgcactgtcatcccataagccactcgggcctctttttctcttgacaccatggcactagttcagcagtgcagagagaagccgtgaggagttccggtgtgaagagaaagaatctgaaaatggaatgctcttcctccctcccctaagtggaaaatgtgaggggaactttttagagtaagtggcagtagcttggctgttgtgaccgaaacaaacgcagccgtataatagtctctgttttagataccagtcatgcaatttccatatctctgtttgccaaagtgctgtttgaaatgttaaatgctaaagggtgactcggaagcatagaaactagagggaggtctgtgactcctccatggagtttccttcttctctctgggcagatggcagagggcaggcct

SEQ ID NO: 11064 - DNA, 1112 bp, Homo sapiens
tttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggcagcatgtctcggtctctcatttcacacaccctccatcttttcctaaggactcagatggaaagttttccatagctaggggaatgagggagagaggagatcatgtaaagaggcaacagctgctaatatatcttgctgggaatgcactctttgggtacgtgatcatgttgcagtttta

SEQ ID NO: 11065 - DNA, 1189 bp, Homo sapiens
aatccagtttctatttccaaatacaatgtataagtgtgtgtattccctctattcactgtgactgtggatcttgatctaaataaaattcaactctaaaaagaaatacagtgctctagtttattaaaacatggtttttaaaaatgttctctggggttgggtatttttgccgtagttctttgctttgattcttgggtagatgctgaatctcccaaatttggtttctctaactgtaaaataaagccagtatcacttgtcttgtggcatcgtaaggattcaatgagctagtgtatgcatactgctcagtaaataggaactattattagggctacttttgtattttttatgtttatggtgaagtctgatgtttttccatatttaaatttaggaagagaaaatcttgcatcagttgaaatgtttgaattaaataatctatgctagttcttagggtaaaaatagttacttaactgggctcttgtgaggtaaccattacaatttaagtaaaaatttacaaatgttaatcattaatagtttaatattacttttcatttcaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgtaaacttatttgtttattctgctctgtgtacatcctcatgctaaccgtagcaacttgcagctctaagtattatgtcataatgacagaggaccattttaaagtcttctatctatggctgtgaagacatcattatataatctagttaacagttactctagtgtcacccattttcaatttccagatcgcttttatcaagatcaggttactgtgaagtaaaaatttggttaaattacaaatgttttgctttcccatctttagccacagccaagttttaagttaacatgatctttctataaactttgtcagtgctccctttaaacattatttaaaacacataattgttactgtatttccaactggtaagacctcaagcacactgtaggtttaaggaggatatggtagttgtctctagaagcctttttttttttttttttttttttgagacggagtctcgctgtctcccaagctggagtgcagtggtgggat

SEQ ID NO: 11066 - DNA, 1192 bp, Homo sapiens
ctcttcagcctactcaccgtgaagatgatgatgacctttttgatgatccacttctacttaatgaataatagatttttcttacgattttgttaaataacaatttttctctagctttattgtaagagtacagtatataatacatacacaaagtatgtgttagtcaaactgttcatgttactggtaaggcttccagttaacagtaggctattagtaaagttttggggagtcaaaagttatatgtggatttttgactgcatgggggttaacacccctaaccttcaccttgttcaagggtcaactgtaatattatcttgaatgaaccttcagtaaattgatattgttcttatttatttttagtagcttcttcatcactcctttttttttgcacgatgtgcagttttagaatttatatgtcacacattggtatgtatatgaaaagcatatattttgaagtagcgcaagtgaatcatgttaaattaataatctaactttaggttggacaccactgcatgaagcttgcaatgttggatattacgatgttgctaagatacttatagcagctggagcagatgttaacacacaaggattagatgatgacactccactccatgattctgctagtagtgggcacagagatgtaagtatgatagaaaaaaatcaataatacacatttgcaaaatataaattcaacccaaagtaatttcattcacttcttagtcatatgatctgtgtcatattccactcattgcttgaacaactcatctatattttgttttcccttttttctactaagtattagttcatagtcagatttagcattttcttttcataaaacccttttaatttgacagttgattaaataatttggcaaaatttttatttcaaggcattctttataagacaattggatgtgttaaagcagtctttatatatagtaaaaattgtacagtgttgaattgcctatcttttgaagggcattttactttagttgagacaaaaatagaatttggagtaaagatagatacaagtgcagttctggcctggccagtttactagctgtgtaatcttgaacaggttacttccctcctcggaacctccgtttcctcatctttaaattatatgataaataatacctatctaaaattgatatttcaaaggaaaaaaagacactacatgtaaatgcacattgaaa

SEQ ID NO: 11067 - DNA, 1192 bp, Homo sapiens
agaattgactcgtatgaacaggacagggtgaaaatgctgggaattattatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatatattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgtttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaata

SEQ ID NO: 11068 - DNA, 2115 bp, Homo sapiens
gggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccaccccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggc

SEQ ID NO: 11069 - DNA, 1670 bp, Homo sapiens
acttgacggaactctgaagtgttccgttggactggtttcatctgtcctatgcacatgtcatttccagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaactagtttattagtttctctggaatctgcctgtgtccctgggtttgggttttgctcttggcagcagcaggtgcctcttgggtgctcctcctgctcctgcctgcagccctaagagcaggtgggtgccgagtgtctggcacagcttggatgccgcccactgaagacagcagaggggggttgtcttgaagctcccgagacacagtcaagcatctctgagcctcgatgtcttcgtcagtaaaatgggaattagtaaaacctgccctgtttctcacagggttgttttgcaggcaaatgagttcctgtgtgaaggtgcttttgtaaagtgctgcgtgtataaatgtttgatgttcctgtaagcctggtttgaaaaccttggcctgtcggagtcccctggtgcttctgtgagttttggttttatttagttagccagcagggactcctcagtaagt

SEQ ID NO: 11070 - DNA, 1086 bp, Homo sapiens
aggaagtgctttgctctgtctcagtccccatggatgcagaactctacagcttttgttttccttacactctaaggaacttgaatagcatgtaagtgcatttccagatacacagagactggaggtaactgtacaggagaggtctgcttaatcactcctctttgcgtatgtttgagacaggtgctcagtaatccagtattacagatgatttaaatgggtaacctattttcatttgtctcgctgatttttaaacattgtctttttgtaattcctttttgtagacagctgattttacttctagagttatatagtcccagagatgtttatgactatttacgtcccattgctctgaatctgtgtgcagacaaagtttcttctgttcgttggatttcctacaagttggtatgtattgaacttttaaaattttagatcagcaaactctaagatcctagaatggaagctgttcctcatttctccatgctcaccctcccaggtcagcgagatggtgaagaagctgcacgcggcaacaccaccaacgttcggagtggacctcatcaatgagcttgtggagaactttggcagatgtcccaagtggtctggtcggcaagcctttgtctttgtctgccaggtaagcgaggccctgggcttacctgtttgtgagtttttctcctagaagaatgtcttctttaacttcctacctctctctcaccctcttccttactcttaaggaacagaaccttatagtagcctggctgtttataggatcatctgcccccattgttgggcatctggtggcccctctctcccagctagccaagcccctccttacactggcatgcaccacacacaccccacgtgcctgctgtatgtgcttgttccacaccacatgcctggtatgtgcgtgttctgctctgcacacattcagacgtgtgtatatgtacatttcacagtgcacatacatgcatgttcctcactgttcctcactgcatattacacaggcatacatacatgtaccccaccacacacatactgtgcacacatataccataccacggttcccactagagggtgctcatgtctgggacccag

SEQ ID NO: 11071 - DNA, 1132 bp, Homo sapiens
gttggcagggtttgtgtgactgctcttctgctaaaatagcttagtaagtaagacttgccagtttgattcatgcactaccaaaacatagttaacgtttactgaaattgactccttttaataagccggaggcagctccagcaactagatagcatttctcttttcatactaacgcagaataatgtacagtagcagataaacatttttaatctcatgaaagcatattagttttctactttttctcttgaaggactaatgatttaccacagtagaaatttttttccagctttttgattgcagtgtcaaaaaagtatatatttcattgataacgtacagtgcaaatggagaacagccttgtaagaatattgcaattgtgtttctcactttgtccatttccttattttgcctgtagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgaggtaacaaactcagtaaagtgtttaccaaatgagagtagtttgaatcagaagtctttcattggggaatagttgtagctaatcacttttagtttgtatgttctgtttgttgctgattttttagctcttcgttttgcataaagtaattgttttcatcacatcctgtcctcgtgacattagtgtcatatgaaatgcctggaaaagtaaatcccacttctgtctatatgaccatttagtagactcaatgttaatgtagctcactgcagtgaaatagtcttactggaaacaaagccctttatcaagaataattaactcttcccttttctttttggagaggtgctttgtttctgatcggaccatttcactgcagcaagcaacacagtattctgagcagaagatcgggacttgaggccatgttgcggagggccagtgacattatctggactctggagtgtgagggtgggtactgatcctagcatcatcttcactgtgtacttgtagctgttctctatgatccttccctaatttcctgctgcatctccatcaagccagc

SEQ ID NO: 11072 - DNA, 1127 bp, Homo sapiens
ttggggttttttttttagacagtcttgctctgtcacccaggctggagtacagtggtgtgatcacggctcactacagacttagcctcatgggttcacgcgcttcttccacctcaggccctgccgagtagctgggaccacaggcatgcgccaccacgccctgctaactttggtattttttgtagagactggatttcgccatgttgcccaggctggtctcaaactgctggactcaagcgatctgcccagctcagcctcccagagtgctgggattacaggcatgagccactgcgcccagccagagaaaatagcttgtaagaatttttcagtcctagctaaagttctgaatctgggcttcctttagaaaagcttcattattatcctaaacatacttcggcatttgaaagtagattattaaatatacataatgtgtgcgtatataattctttttcaaaatgattcctttattattgtcctttttatcttcctaggttcgccaagcagcttttcagtctctgggacctttcatatctacttttgctaatccatctagctcaggccagtattttaaagaagaaagcaaaagttcagaagagatgtcagtagaaaacaaaaataggtataattttgaaaccattttctaattttaaaaccttgttttctaattttactgcttttaaacattatttccactattctgcaacaaatgttattttttgatagtttgctatttctcttgaatataaaaattggtgaatatttttatagagctttactttaagcgcatttgtttgttaagtatctctttggttggttacatattgaatgagtagatgcatgtaacacaattagctagatgcctcgcacataggaaactctaaatggtagattatgacttttaaaaaatgtttatttagtacattatttagtcaatcattcattgatatctacaatatacagggtaattgttacacactgtgtagtatttgggtttttttaaatttgtttttaaggagtaaaacttaatttaggaatatgttttattgtccttttctgtcaaataatttagttgcgcatcttggattctttgtcaatggtgattgtaatctgtcagttaaaggagaaagcca

SEQ ID NO: 11073 - DNA, 1160 bp, Homo sapiens
ataccttgcagatcagaataatcaggtaagagtaccatttatatgttcttaaaagaaatttacgtagtgtaatatatggagaatagccgagcctaagtgttctctttggaatgttttactgtttttcaaaaatgaatatttatcttagacaagatgtgtttagagtctgacaaatctagtagatccctttaatgccattatggacaatgcctagtaactgcactctcacttggtaacctcctagcggtcccttaaaaggtttgttactttgtgaggcatcttttaccaggatggctctgtccacttcctctgttacagcacaatctacgaagttctgtagtctttgtaatagttgaagaaaataaacacaaatatttatttgcggagttttgccagttatgggtccctttgagatgagaaatctttgtttataaaaatcaagtgatagaattttgtcatgttgcatatgtactttctttgtgttgttatttttctcctaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctgtaagtcaaatgccatttttccacttatgcaaaatgtggctgataagaggtgcttattaaaagtcaggccggggttaggcacggtggctcatgcctgtaattccagcactttgggaggccgaggtgggtggatcacttgaggtcaggagttggagaccagcctgggcaatatggtgacacctggctctgccaaaaaaatacaaaaattagccaggcatggtggtgtgcgcctgtagtccctgttacttgggaggctgaggcaggagaatcacttgaacctgggaggaggtggaggttgtagtgagccaagatcaggccactgcacttcagcctgggcgacagagcaagactccgcctcaaggaaaaaaaaaaaaattaggctgggctgggtgcagtggctcatgcctgtaatcccagcactttgggaggccaaggtgggaggatcacttgagaccaggggtttgagatcagcctggccaacatggcaaaaccccatctctactaaaaatacaa

SEQ ID NO: 11074 - DNA, 1185 bp, Homo sapiens
taaatattcagtctcatcttgttaaaataaaatcaatactgccgtttgccacttaggaaattatagacctaatatatgttttaataatgtaataagaaaaaattttcttaaaaaatatacagattttgtcttttaaaattctagatatcggccaggtgcagtgactcatgcctgtaatcccagcactttgggaggccaaggcaggtggattgcttgagcccgggagtttgagaccagcctgggcaacatggtgaaacagcatctctactaaagatatttaaaaattagccaggtgtggtggtgcatgcctgtagtctcagctactcaggaggctgaggtgggaggattacctgagccagggaagtcaatgctgcagttagccgtgatcacaccattacactccggcctgggcaacaggaatgaggccctgtctcaaaaaattaaaattctggatattagctattgatgccattgaacatacataattttgttttttttgtgtagacaaatggtggcccggagtttgctcgataccttgagggaagtctgcgatgatgaaagagattgtattgctgttttggaaagaattagcagattggccgatgattcaggtatatgtggagaaagtgaatttactctattctagaaaggcttctttgatcaaatttgtgtttctaaaaactaatgaacaagttaatgtgatatgagatagctttaaaatatttcctaagtaattatcaaacccatcagtgacaacaaaagtaaaatttgttactgagacctggacattttacagtgggctcatttagtttaattttagaaatttctcatcaaaacaaatctaaaaacattgttttgcatcatgtatagtaatattttaggattaataaaaatatatagaataattttgaatacattaaaagagatggaggaggctgtaaattattttaggcaactatagaaagcttgctttctgtgtggtttctcacttgcaaaaaaatgttgattaaccatttgtaaaactaaagctggtttatctccaaagtgaagataagaaagtctgcttaagaaagaggtaaacttgatttaaggcttagaaaatggtgatgttaaagtttttataaatatatcttttgttgtagtaaaatatacttaaaacttaacacataaaactattttaaggta

SEQ ID NO: 11075 - DNA, 1173 bp, Homo sapiens
tggttaatcatgctgtgtgctagccagggccagctggtaccttctttgccatgagcattcaagggacggctaacctttattgacaatctatatcgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgagttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgt

SEQ ID NO: 11076 - DNA, 1212 bp, Homo sapiens
ttagcgtccgcgaaccccaccccattgcctccaacagacctagctctcctttccaccctcaaacagccgttactacagttcccagcaagcaccgcgcagggccgcaaagggccaggccctcggcgaaggccccgccccgcagggggcatgccgggagttgtagtgagtgggcgcttccctactactacttgtcccttccactgggcattcccacttggaagagtgtgatgcgctgccagagcagtttctctagttccgtactcggagctcaaggtgacagaggactgcgcttccagccctgcgctgcgcatcgcgtcggtcccgcggacctttgccccgcctccttccacacccgttcccttgacagctgggctgcgctccgggccgcggcaagccgcgagcgcgcaggcgcagcagccccgcgccgcgctaggccggcctggagggcgggacaagcgctagaagctcccggccgggggcgcgcacgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggtaggcagaacggggacacccccgggtggggtggggcgcgcggaccgctggctgtcggcgggggggcgcggagggcacgtccgcggccctggcccgagggagcgccccctcccccacgccccggcgccttccctttcccggctgctttcttgccgccacctcggccggcctgccccttgctccggcccgcttcatcccctcccgcccgccctcgctgcggtgcgcgcgccggccggggcgaggcggaggggagcccggccctggcgccgccgccgccgccatcttgcggtcccgcgggggcgcctcctgggcgtccggtcccgcccgcgccgcggtccgcctgggcccgcgtccttggccccagaggccgacgg

SEQ ID NO: 11077 - DNA, 1196 bp, Homo sapiens
atgtgaatgaatgaatggattgaatgaatgaacaaacaaaattgaggtgaagcaaaagcactgatgtcatagggtgtagggtcttcagatgtagagatttttgcagttggcctagtaaaatgaacttgaagattgacactggtttgcagacaactgggaaattctgttattttcagcaacgtattaacaacatactgtaaaaatacagttgtaaagttcatagatccaaagtttcatagtacttttttgatagaaatcatacatgtttatggtagaaattttgtgaaatacagggaatgaagaagaaaatatgacttgtttttaagtctgccacctcgagaaaggcagtgttagtagccatttgggatatttatgcctacaaatgtcagcacttaattaaaattgaggttatatattttcagttttgaatccttcgttgttgagaatccaattaaattttgttttctctttaatttttaaactttacaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcaggtagcaaatcatgttctgaatttatgtacatttgaattttgaccttttatgattatgtttttgtttaataaggtttcatctggagggagggaaataattcttatattattctggttttgcctttaaagatgtcttgttacagtactctgcaagctgtttcagaaaatttctcactcatcttctgtgtagggagtgtggtcagtttataagaaattattgtcaattacaaactttagtctttatttctacagctaaccactaccttctctgcctttgttattttatctttgaaaaattatatcatttttctgatgggtcattctccttcagatcatgatcatattacacattgcatgcagctatagaagtgtcataattcttttgcttaaaaaggtgcaatgccacttttttgcctactgtgtcaaatcagatgagtctttatgcctttcattgtaaatgtcaacagtgtcctgtgtgtgaaaactttatttttattttactactctcttatgtgtttacttgtcaaagaagtatgcttgccatatatggattac

SEQ ID NO: 11078 - DNA, 1435 bp, Homo sapiens
cccactgtgagtgtacaattcattgatacatagaactttgtaaccatcactatagttcagttttagaatgtctatcacccccggaaagtttccttatgtggttagcagttaatccccttttccgtccccagccataggcaaccactaatctactttccgtccctatagatttttagctccagtagtctcgttagtatgcttgtttttaaaaaccttttgtgtgtgtgttttttttctaggatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagt

SEQ ID NO: 11079 - DNA, 1204 bp, Homo sapiens
aaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctatttttacatcatttgtcttaccttgttgagagaggagactggcttgttggcttctggttgttgcaggaggcatgtggcttcctgccttctcagtagacaggatcattaggaaaatagcaacatcaatcctgttacacaggagcagtgacacgggtggctgcagtgtggtacatgccacacaaatgatagagaaagtgcccgttcattgcagtttcctcttcctgggggacctgagccctgactcactgtcttattaggggcaggcggaagaa

SEQ ID NO: 11080 - DNA, 1159 bp, Homo sapiens
gaggctgagatgacagcctctgagttggatgtggggtgtgagagaaagagaggagccaagggtgacttcaggggtttaggcctgaaaagctggttgaatggatttgccactttccgagatggcaaaactgcaggaggaacaggtttggagctgagagtcgagtgttctcttctgtgcaggttaagctcgaattgccagtagatttcttattttatttttttgagacagggtatcgctttgtttccctggctggagtgcagtggtgcaatcacagcttctacctcctgggctcaagtgattctcccacctcagcctcctgagtagctgggactacaggcatgtgtcaccatgcctggataatatgtattttttaattttttgtacagacggggtttcactaagtggagatgttggatttgcacccaagctgacggcagagatgcagtgtggaagtcatattcctggagatggtatttagggccatgtcccggacaggaggagagcaggcttggccactgatgggctttgccgtcggatgagctcaggtcaggctcccattttcctccttgggagcctcacaaatgccagtttgtggaggtcatttctgaagtggttcatttctccagaaaaggcttccctgctcttcctgcctgggctgagcgcacctgtcgctggaggaagaggaggcaggagggggagaggaggcggtggtgatggcctccagctcctgcctcgcctggtccacacctgcagtgtttgcttagctctgcagggtggggtcagcctacgtgagaaattcgaaaactcaacaacatttcaaacatcagcagagacagaattcctgtgagacagcagctggcaggcacagagtagcagctgtccctttggtggggtgggggtcggtacatggtctccaagggtccgaggcccactgctcctgaccctatctgagaggtccctatcatttcctacccattttgctaacaaaagctgtctcagaagaagggggagggcagaaggcactgcccttgcctctgggcagcctcatcccagcccttggcactccagggtgccagtgaggtcccacctgtgcccccttaaggagaggctggtagatggctcatccccacggggagagtgagtcctggactctgtggcc

SEQ ID NO: 11081 - DNA, 1440 bp, Homo sapiens
agaagggcagctcccctgttcgggtctagcccattgcttgcatttcttaggacttttatgttctccatctcttaaggcagtggcagcttcagagccgcactctgttctgtgcagcccttgactgcattcacactggggtggggcgggagaggctccatccctctattctttgccgaattcactcctagaccacctgtttaatacgagtgttggggcttgggcacggttccatgtgccatttcctgtgctgtgtgcatgtgggataagttgttacacaacattgttcagccctctctggtaacccggatgcctggctctctctgtctgtccccaggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggccctgtgtgtatctgtttcctctataagcatgtcgcctgattcccaaacaactctgtggctctcatccactgctgtggatctatgctctcaggaagctttgcgaatgaaacccaaagtccatgcgaatgaaacccaaagtccatgcgaatgaaacccaaagtccagtgtgtgccagctgctgcctctgatgaataccctgaaggcgaccccagtaatatcatgtgagtgttcagaagccaagacatgggacagacagaaggaaactaatctctgaaagctgttgtttctgtgatcagcttttttgtttttgtttgagttggggtcttgctctgtctcccagcctggagtgcagtggtgtgatcacagctcactgtagccttgacctcaggactcaagtgatcttcctgccttagccttctgagttgggaccacaggcatgcactagcatgccaggctaatttttaaaaattttttggtagagatggggtctcactgtgttgcccaggctggtctcaaactcctggactcaagtgatcctctcacctcagccttccaaagtgctgggattgaa

SEQ ID NO: 11082 - DNA, 1144 bp, Homo sapiens
ccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcatctctctagccatgtgcataaatgacgtaagttactttgtatggttacaatggctacttgggtcactggtctctccctggggtgaactcctccccacttcagttcacgaaaacaacagaggaaagggctcttctttaaatggaggctttaaggggggcagccaaaactgttgctagctggaaggcaatgcagtacagacaaaagcccctcctccatccgcagccaccttttagactcccacaggatcttgcattttcccaagtcaggtcctgggctagggttccccaaccttgtaggggaacaa

SEQ ID NO: 11083 - DNA, 1142 bp, Homo sapiens
gattcattccttttgtacacatttatacttatcttgatgaagcagtggtttagggtattaacattcaatgcattgacctttggtaggattttagcataaagaacccctttgtatcaaagagtgccattcccatctttgaactatcatttatgtttacatttcacagttttccaggatttttaggtgattcttctctcatcagaacttcttctttgggggttgtctttaataagaccatgttagtaaccccacttaaagtctgggcagatgctccatttatttcgaagagttggttgccatggagcttatttgggaattctgttgcctttgaagaacacttgcaagttaccctcctttgtattaagtgcagaaggtataccttggtgtagctatatatatttatattgatatcttgcaccacatgtgaaagctggaggtgagcagccagtcctaacccgtgttgcgctgtgtgtccccagctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaaggtaaaatgaaatttaagattaactttttgaaatgtttcttgatctctgaagttataattctgtgaagtttgattacttattatagatagctgtttttctgtccttcctctttctcagcttactaggctagcctctgcccaactcgaggatcgttttgggtcagttctgtgtgcatgtgtcttgtatagtgtatgtattcctgaaaatatctgtgtcacctcctcttggaagattttcttgattcgtcttccttttccctccaatctgatttagatgccctatctctcagcaactgtaggcccgctgtagctcactgacaatgtcacactctgctgtcacccagtgtcccttcgagggatgtatgtggacaggacacctgtgctggcgct

SEQ ID NO: 11084 - DNA, 1239 bp, Homo sapiens
taggcatagcttccagttcttccttccgtgtcctggtttcttgttcagttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagtttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcagactttctgtgttgagttgctatcgtaagacggtgatgtcttttggtaattagctgtcagaaatcacctcaattgggaaggcagggtacttttataagcagcctgtgatctttgaagaaatacagtctaggccgggcatggtggttcacgcctgtaatcccagcactttgggaggctgaggcagacggatcacctgaggtcaggagttcaagcgattctcgtgcctcagcctcccaagtacctgggattacaagtgcccgccaccatgcccagctaatttttgtatttttgtacatggtggccaacatagtgaaaccccatctctactaaaaatacagaaattagccaggcgtggtggtgtgctcctgtaatcccagctactggggaggcaaggcacaagaatcgcttgaacccggcaggt

SEQ ID NO: 11085 - DNA, 2003 bp, Homo sapiens
ccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactgtattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttga

SEQ ID NO: 11086 - DNA, 3087 bp, Homo sapiens
gaggttttaagtacatgcatcaaaacaatttcaggttaccgtggaagataccagattataaagattatttcatgaaacaaataatattagagttgattttttaaagtctggtttttggtcactgcctgtactgcatattttcttttgtaaatagcttctattttttgatctgtattcttattgtgccaataaccatctgtgttagatctgtgatgcattttcccttttccatttgtattatgtcctttaacagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtgtatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttctagcatgtgttttctcctctttggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaatgtggactttttggtcttttttttttttttttttttttaaaggaaattgcctttcactacttggaattactgtttaaagcttttgtaattattatccaagtaggttatgtaataaaatatatttaaaaatatacgaatctcttgccttataaaaacagaatgtattttatttaagataattgccaaggcttactcttctttcactatctcacaaaaaacccaaacaaaaattaggagatgtgagcaaatattacatttatttaaaaggtagaaagtcagtatgtagactactaacatttagaatggacagatgttgactttcagtctaattagtcaacattagaatattttctagaatattttaaaatgagaatgtacttgattataattgtggtaaaatgattaaaactagtaatatgcttgttggttcagttttgtcaggaattgtcaagggtttaacctcttatcagggctagagagagaggtgttttgaacagtatttcatgtaacagattacatgaaatatcaggtaatcac

SEQ ID NO: 11087 - DNA, 1218 bp, Homo sapiens
tctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattgggtaagatgctttttctctattattattacttgctattattttctcaaatgacaccacaaagctagtttgtttcaaggagttactggttagcattaattccttgtaagttttgtgcttcttcctaaactgagaacaccgtgtatttctgtgcaagcgtccctaaagttggcttagaaaaacgctacacttatgcaggtgacaggctgcctatggctctgtcttccttatctctcttttgctctgccattccagttttgtgattatttcccctaggaaatgtccagtttagaattgaatcccagaatgagtgagtgcctccaccttgtgagtctctgggtggctgctgtggtggagaggcagcactctcgggtgcatttgtggggcagcttctctctgggagctgtgcttttactgacatggtgcac

SEQ ID NO: 11088 - DNA, 1027 bp, Homo sapiens
tgttttgttttgtttttttgaaacggagtcttgctctgtcactgaggctggagtgcagtggcatgatctcagctcactgcaagctccacctcccgggttcaagtgattctcctgcctcagcctcccaagtagctgggactacaggcgcgtgccaccacatccggctaactttttgtatttttagtagagacggggcttcaccgtgttagccaggatggtctcgatctcctaacctcgtgatccgccagccttggcctcccaaagtgctgggattacaggcgtgagccgccacgcccagcctagaacaagaaagttttagcgataacagccatggttcacgaggagccccacatgtcaggccctacggcgtgcacattccttgggtcttcacaactgtcctgccaggtaagtatcgctgttgctgttctatagatgagactttaaaacctgtcagggacattaattaatttgagatgaagctaatattcggaccacccaggtctattaagattcaaagcctgtgctgccctttaactgtaagcgggaaatattcaaggagccagatcacctgggaatcccatgccaaatacagcgcctcacctactgccctgaagccctggcccccgggcccgcgtggagtggcccccgggcctgcgtggagtggcttgctctaggtgctggtgtaggttgccagaacgttttgtgcttatagatgactggtaacagtggagacaaatacaactctgtaaatgaaaatggcttcgtaagcagggaaagtgatataagagccgctatatacagctgcagttttttttttagaataataaaaaaaaatgtatgtgcttactagtaagtcctttagaaagtatttttagtcaccactctgctatgttcaaaaactgagcttttgcacttctgatttttttagcatgaaagggtaaagttgggtgaatgaggtttgcattattaaggcaaaagctagagtcttgacagaaacatgacattaagacttttgggaagctgtttt

SEQ ID NO: 11089 - DNA, 1106 bp, Homo sapiens
tgtagtattaagttagtactaaatgagattgcagaacgtactgcatcatgttccctgaggacaatgggagtcaagacctcattcttcctttctggacttgaatggtctgggggaccacacctccttcccagaattcatctgcaatcatgaattttggcctgaccttctggttcttgaaacatctttcccctgcatttggcgcttgtaacttgtctttgagaaatgctgagtcaggccaattgatgatattttccctctagaatttttcctttgtgacttttgtgtcaagtttgttcattttaagtagtcaaaacaagcttttaattgtcttgcttcttcagggttaggctttgaaaatcaagctgtattcttctttatgcatcattgacagtcaccaacaataataattacagatcataattatcttgtggcaattatgataagaattattttcttagtagaaagaatgcatcctgatttcagaaacctccagggcagtgtataacatgaagcctgttctttgttccggtgacttgattggacagtcatagtggagagatgcacaggccgccagaggcattctcagagtatcaagtctctacagatgaagggcgcttgtggagaagcatgtttcagtgcgttttctctgggacaacatgccccataagaaaagttgaatacaattaaacacgtcctgcctgcagccaaagcagattttcactgtccttgaaagtgaggattgaacacaacctcccttccctctccctccctctgtccagcttcttctcttttggattttgaacaatgtaaatgttagaaaaactttgaagtgagaaagaaaaagacaaatttgccctgagcatgtcaggtacacgttctgcttgacgcttctgtgtgggcctccctgttgcagtctctaggggaggataggcacactgtctccagaaagaggacagtgaacttccagctgcatttgactgatactaggccatttttagttcttagagaaacaacattaaaacctaaacttcatcctttttattttgataaaacgaacttcccctcattttttaatcaaatacatggcaaaggtcagccttatcctc

SEQ ID NO: 11090 - DNA, 1243 bp, Homo sapiens
atggggattttcctcttcagaagctgcttgagagcctaagaattttcaccaaattatgaacaagacagattgttttatttattgtaatcatatgagaaactgaactcttatttatttcttctttaggtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttatgtgaactgttgtccttgctttacaccaccatttggaaaacttaccagtttttagatgtagatgtagtgaaaaacttcaagaatgaagcagagcaattgagtat

SEQ ID NO: 11091 - DNA, 1417 bp, Homo sapiens
gatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccgttattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagaccaccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctgacagctgtttggttcatttaccatttggaaactagtactgatccagatattctagtacatgaattttggtgcacataggtacatacttctgcttaggaatgtgctacaatttgaatgtttgtccttctagatcttatgttgaaatttgatccccagtgttggaggtagggcctaatgggaggtgtttgggtcggggggcgggtccctgatggatagattaatgccttgcggtggtgggagtgtgagttcttgctcagttagttcccaaggacaagt

SEQ ID NO: 11092 - DNA, 2057 bp, Homo sapiens
tccctcaacagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtagaaggttgcaccaacataaaaaggaaatatggcaatacatccatgatgttttccagttaacataggaattaccagataaatactgttaaactcttgtccagtaacaagagttgattcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattgaaagccgcactgatggatatgtaataataaacatatctgttattaatatactaatgactctgtgctcatttaatgagaaataaaagtaatttatggatgggtatctttaatttttactgcaatgtgttttctcatggctgaaatgaatggaaaacatacttcaaattagtctctgattgtatataaatgtttgtgaaattccatggttagattaaagtgtatttttaaaagataaaacgtggtcttgggctctaaaacaagagtgggaatagttcacatgaaaagctggctaaagtgtgttggaaaacaattctccatgggtctcttgcatttctacacatcagggaagcagaggctctgacaacctttcttttgactatcttttccaaggatatttatgtagtaaacagccttggaagatagagttctcccttgtgaggatgtcgggttcttttactgtccagtataataaagataacgtctcccacctatgatgcaaacccactgtgtgctcagcacccacctgggccactctgcattgcccacatggggcttggagggcaaagggaactgatggaacgtgaaacttatgctgcttttgctgtgctgtgaatgaagtcatctgactctgaccc

SEQ ID NO: 11093 - DNA, 1177 bp, Homo sapiens
tacaatttaggtatttctctaagaatagtattattagttaatacctaacatttgagtgtttgctatgtgtcagaccctgtgtgtttagtcctgcattattttatgtaatcattacgacagtcctatgaggtagggtttataattgaggaatctggaacttagatgataattaagagccgtttgtgtgaaaagtgttgaaacactgaactaaagctgtgatgtggagatgaagacgagacagatacacattgaaaagataaaattgaagaattgacacagttgaattgataggaatttataaacaaccagaaaaagatcatggcaaagaggttaaggtaagtgggaattttggtttgggtaattgaattagattgacagatgggaatacaggggaattaggttgggaggattggatggggatgtcctcagttttggtcaagattttaaggtggttgtagaaagagtctcttaagtggagaaaccttttagtatacaattggatatgtgaatctagagtttcagaaaggttctaactgagaaacaaatttatgagttcacttatttatttgaaggttcacaaggtcaccctggggtttgtaaaatgagaaggtagaagagagttgtgaggtacaccatcatttaagagtctcaaagaagactgcctaagaaggcatgagcagcaaggtaggagagccagaagagagtggtagaaaccaagggaaaaatgtcaagaatcaaagaatgatcaaccctgtcataccacagttgaagactgaagagagcccaagtgatgttaggaaaagagcagtctcagtggagtggtggaggcagcagggacacggtgagtgtacactaatggccacagactgtagaagagggtgagtctgtaattgctgactatataaaggtgcttatagattttttgttagcagccctcatgtagttgttggttgtttataaaaatatctagcatagagacatggtaagagccacaaatatagtcaggaactacaagattttatgggcgatgcttttatctgcatggacacacagataaaaagcagtattttactacttcataatatgcaagagtgaacttggtttatctactgaaagcctgactgttgtaaggacagtcagtgagtacaacaaacctgcagtgttattttaattgttc

SEQ ID NO: 11094 - DNA, 1265 bp, Homo sapiens
aaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtgaccaatgtactaactgagaataatggtgtgttgtcatttgtgctttttcagggtgtttttttggtttgatatcttgaaatatgattaaaacattggcttcctaaaggcagtttccaccagtttgccaaaggatcattgtgtcagcagcaaatcagctgaactttatttccaaaggcaaaatcctttctgattattttagtaacatagtacttttatgatgttgcaaataaatgaagggcccacagcccaagaatgaattaccactgtggttcaacttaggttatttttgtgagctgaaatgatcatatctcagttgaaaactggctaaaatttagg

SEQ ID NO: 11095 - DNA, 2156 bp, Homo sapiens
tgttttttaatttttcagaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcacgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacgtttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataaggtaatctgtttttattatgca

SEQ ID NO: 11096 - DNA, 1138 bp, Homo sapiens
caggaaccatttgttaaaataagatagtactaagcacttaatggaaaaaataattccagggctttcattcatattctctagttagttattgtggttctaatgcagtgatagtaagttatccaggcataaaagtgagtattttcaacacctggaactttgtgttctgatacaaggttgaatagtcttttatagactctacttttactcagtctttgttataactcatattatttcaatttttgagtctgtttggcttttttctttttttaaaaaaagctttctagttctaaaattttatacttatagggaattctcaagaccttttaaaactagatggtacctgaaactaaaatatctacatgttatttaaagataatgcagctgcctgttgttgtgaggtttttttctccctttattcaattgcctctgaaattacaggtgagcagaatggcaacaggaatcctggtggattgcagattggtgacctggtaaatatagatctcgacctcgaaattgtacagtctttgcagcatggtcatggaggatggactgatggaatgtttgagactttaactacaactggaactgtttgtggcattgatgaagatcatgacattgtagtacagtatccaagtggcaataggtgggtgatatctctcaatttttgacaatgacaaataaaactaatatagagaaaagtcttagagaaagcaaataaagtgatacaaccaaatactcattaaagctagcttttagatggtaagtaaaaatccagaatatatattggtaaggtggagagaaacaaatgataagaattacgtgtgtgtgtgtgtgtgtgtgtgtgtgtgtcttgtgtgtgtatgtgaatttatatgaggatgtttatgatacagtgttctgtacactatttttccttcaagaggagaatacattatatcactattaggtctgaatacagcttaaaagttctgtgttcgtattggactatatcagtctaccctgaataggaagggttttacattaaaactcctttggtgcatatctccagggtcatctcttattttttgtttttattgatacacaagaggtgtacatattttgggatacatgtgatattttcatccatgcatacaatgta

SEQ ID NO: 11097 - DNA, 1061 bp, Homo sapiens
gaccagccaggctaacatggtgaaatcctgtctctactaaaaatacaaaaattagctgggcacagtggcatgcgcctgtaatcccagctacttgggaggctgaggcaggagaatcatgcagtgagccgagatcatgccactgcactccagcctgggtgacagagcaagactctgtctaaaaaaaaaaaaaacaaaacagaaaacaaacaatgtatcaatatatatgtatttgtgtatatataaataaacacaaatcattcaggatataattgcaaaggattgccttactcttttgatcttcactgtttaagaattttgtattaaaattaagcaaagctacccattttgaggtttagctttgctcttgtaggtggaccttcaatcctgctgttctcactaaagcgaacattgtccgaagtggagatgctgctcagggtgcagaaggaggcacctcgcagtttcaagtgggtgatcttgtacaagtttgttatgacctggaacgaattaaacttctacaaagaggacatggagaatgggctgaagcgatgcttccagtaagtatgtttagaataattctgggctagaaattacaatatacttatgtcatttttaaaagtaaattaatgtagaaattaaattggcataaaacttcttagaattgtactctccatttgcacctagacatactcgtgcattttgttttctaatttatcccagttaaattagcctgggaagatccagaaaaggttacagttaatatttaatattttttgatagagtggttattggagaatgttgtgtggtgcaagtcagcagtggtttttctgatacttaaccccagaatgatataggtctatgcccatctggtctctagcagtgctggaccagtgcagctttcctgatgtgggggcctgcctctttaaaacttgagtatgaaagagcagctcagaaatgtgtgtgctttcatagagtgaatttgttcccaaagagctacagttttttatttagtcattttttcgtcaaatgttcatcaacaacaaacaaatttgcttgttctgccc

SEQ ID NO: 11098 - DNA, 1187 bp, Homo sapiens
gaattttcaacgaagaagagtgaaaacctatggaataaaattttgggaaaatgaacaggtttaggaatatgaggaagggaaggaaaggaactggcagaaatcagatgattccaaaaagggtttaaacatagatgtaagcttgagcccttcttggccaaattagtttatttttttattttttgttttttttagaaatccaattttctttttcaggctatattgatgatagattttagactacttgagttgcaagttctcaaaatgtaccttacagatttcagaagtaaggattgaacatcaaaatagatgtttatgaactcgtatgaataggatagactttatcatgatttgtctcatattcttgtggaagtagttttattattattttaaaagatattttttaacatttgtacttattcaaataacccatttcagtatggttatcctttgaaagttttttcattagtaataagtaaaatcattactttaagcatataaaaactagtgattgactttatggtatatactttagacttggaaacatgaatctatttttttccccaagactttaggtaaagttggccgagtacaacagatttattcagacagtgatttaaaggtggaagtttgtggaacatcttggacatacaatccagcagcagtttccaaggtggcatctgcaggatcagccattagcaatgcatctggtggtatgttttatattgtgtttctttaagagtaatgtggtttacattaaaacctttgctaattccccagttctcatatacagataatgttgtacatgtgcttggctttgtcccagattacacagccttacttgaatgttgaccaccttttaaactttcactaaaaatttttgttttttataatgtgttgaacaacctttattctggctgaagtactccctggagaagttccataaaatgtgtgctttttcttgggcatatcaggggattttccacatcaaatttgagattcctaaaattcagaattctactctttagtcagaacttttgttttctgccaaagaaccatcactttcttagacttctttattttttctgtatttccaacattattgctagcagatggctttccttcctgtatatttttacatatcagttattttttctcttaccatttaatgagttgttatacatgctacc

SEQ ID NO: 11099 - DNA, 1202 bp, Homo sapiens
acactgttcgtatttattgttatttgaaattcctcttgatatcctccatggctttcttcatgaccatacatttggagaaaattgaccaaaagagaatggaatcaataataacagttccttgtttgtttacataatagaagaattttgaacattatgatttggtcctggtggaagtgcttaaaatatctcaagtcatacatctaaagttgaaaagagaaataaagtcctaaatatccctccgttatcatcatcttagagtagatgaattaagcaacatattgattctcatatatttttattttctctaattcaatatatttaaataaccagaacacgtgactctttgtaaggagccacagggttggagaagagtagaaggcaaaagcataaaaatgattagctttagtggtaacttcttcagtaggtccagggtgttctcaccattactttagatatgttgaagtttcttatggatgtggacactttgccaaaatgagacatctttctcttttagcttttggtccgtgcaggtgccaagcttgatattcaggataaggatggggatactcctttgcatgaagctctaaggcatcacactttgtctcagctacgtcagctccaagatatgcaagatgtggggaaggtggatgctgcctgggagccatccaaaaacacggtgagtaaagatcatctttcattcagtaccagtggaagaatcttttcatgcaagatcttatatttactggtaatctaacctgtattggataaaatattttatcagagctatgtacttagaaacttagtttatgaacttagtactagtcagtactaacttattgctccacatttttaccaaaagttgttcagttctgttgttgttgttgttgttatgtggagtcccactctgtcacccaggctggagtgcttggctcactgcaaccacctgggtttaagccattctcttgcctcaacctcccaagtagctgggattataggcgcctgcaccacacctagctaatttttgtatttttagtagagacggagtttcaccatgttggtcaggctggtctcgaactcctgacctcaggtgatccacccgcctcggtctcccacagtgctgggattacaggcctgagccactgcgcccagccattcagttcttttttaacatcagccattcaaatagatacgtagtggtatct

SEQ ID NO: 11100 - DNA, 1918 bp, Homo sapiens
atgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctgctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagctagctatggaagcataaaattaattgataattaatgttggaaatacatttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcatgaactaagagaattagagatggggtagagtaggatcaggacagtggggttacaacagataggaaaggaaagtcagcatttgagtgtagagaaaaaaagaggatcatacagatgtcatcaaattataggctttaatacaggttgctttttttaatccaaaaggaaaagcacttatcctatcagaatgtctaccatgttttatagtaataatttgtgtaaaaaattgaatttttgaatagttttttgtattttttgtgatgaaaaactcataacataaaatttaccatattaactgtttctaaagaatacagttcagccatgtgaagtacatttacactgttgtgaagcagatctccagaactttttcatcttgcaaaactgaaactccatacccattaaacaactcccctttttgttttctcctcagtggaatagaattttgactccatataaatcaagaaacacctaaattctttagttgtttgtgtttgcaagatctaaggtcatggtaaacattaagttcttaaaatttttgggagggacagtgcacctctcctct

SEQ ID NO: 11101 - DNA, 1252 bp, Homo sapiens
tttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatcgaggccacagtttgctattttagtatgaaaggaggatctgtttgggaaacatagattgtcttcccctcaaatgaggggaaaaaaaaaagaccctttgttcaaatggattctgttgtaaaaaattatttttaaaggaaatcacaaattgtatgtcattcttaatgctagtcttatagaataaatccataaaattgtttttatgttcagta

SEQ ID NO: 11102 - DNA, 1435 bp, Homo sapiens
tattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactgctgtgtggcattcttggagtgtgctgtgaatgtgctttttaagaaattaaaaagagatcattttaaa

SEQ ID NO: 11103 - DNA, 1253 bp, Homo sapiens
aaagttagcacattctttgctttctacttcagcctcaaggacaggaagttcattctcgctctttacattggggtgttgatgtttgtggttttgttgttttgttcttcatgttactcatgatgtattgatattaattaacctaaatacatatggaaatattctttcattacttagagcttatatagttcctggtgcagatgtgcaaaaatagtgctttagtaattgctaagtcactatcttgcttttctctctactgtgattgagtatttcttacatggaactatagcttcctcttatcaacaaataagcaggaaatagaaattatgtaaataagcaatttccattacctacttcactgacttgacaaataggcatttggtctgctttaattaatatttttcaaaatgttaagtgcctgttgctgttacttaattttgcaggtagcattggaagtttctgtgattgtacttgagtgggcacttcttgttgaaatttaccattgagaccctggtaacactgaagtttgtgttgactttctgtaggtgttttcacagtcctgtgtttggtatggagagtgtggaattgcatatggggacaagaggtacaattgcgaatattctggcccaccaaaaccattgccaaaggatggatatgacttagtgcaggtaagttcattatcttaggcactgggaacacaaaatgctgatcacaagatcctctgtaattattccttaaatgttattgcagggtggaggtggagatgagactaacaggcttaagtcttatcccggactctcaaactctaacctgtggcatacagtgcagagaaagaacaccgtaactccaaaggcttaatttttcaggggctgactttatacctctcataaagtttcccaatagcaggttgctatttagagactgaccttggtacttcgtatgttgcccttgcagcatctgcaaaatatattagaagttagctggttttgattcctagatttcaggactcaaatggactctgttgctaagtggctttgacgtccttgtcccctggtcatttcagtgttttctctgtgttccactgagagcctgtgaattttggctgctaccaggattctgattcctgttctttttttaccatcctgtgatacacagggatattagaactggaaaaatcatgtgaaaagcctggttttagaggcttaaagtaatcaaaagtcaagtcgacatgataacagagttcctaggctcacttg

SEQ ID NO: 11104 - DNA, 1621 bp, Homo sapiens
ttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttccccaaaagtgtggtttcttttaaaatttcaaatatactaatgttgccacttaatactatcctaaattgttagacgtgtcctacgaaagaagtccttgtggtaccatagctcccagggtcaaggagatgataaccagttacctggcatgcatagtggtaagtaggcatttatctatccagagattaactgaatgctagatagatacagcatagagaggtgctaccgtattcattcggtgtgaatctcaaatgcagaatcaagtggaactacctggttagaaaatttgttactagatctgttagagtgggaatagtttaaaaaagtatacacataggagttggaaaatgctattgctttataagtctgaaaagatagatgattgataggccttttgtgtttggttggttggttgtagtcctcctaaattacaaaaaaaagcaatacaaaattgtatgcttgcatgaagtttattgata

SEQ ID NO: 11105 - DNA, 1217 bp, Homo sapiens
agaccctataagaaagaaagaaagatagaaaggaaggaaggaagggaaaagaaaagaaatagctggatgtggtggcatactcctgtaatcccagctactcgggaggctgaggcaggagaatcacttgaacccagcaggcagaggttgcagtgagccaagattgtgccactgtattccagcctggacaacacagcgagattctatctcaaaaaaaaaaaaaaaaaggaaaaaaagaaaaagaaagaagtgtaataagagggaaatgtgcttatgagagattcgtcagagagatacggtgtttctgccttagaaactgcaggaaagggggctgtgagccaaggaaggtggacagtctctagcaacgggaaaagcaaggaaatgaattctcccctagagcccttgcaacaccttgatttttcccaacaagacctattctggacttctcaaatacagaactgtgaggtaacacatttctttctgttgttttaagccaccgagtttgtggtcatttgttatagcagcggtagaaagctagacactctaatagaaaaagcagcctcatgctagcaagcatgtaggtgttctcatttgttttctgctgtatttgctacttttactgggtttttgccttttgttttaaatcaagtcatttccctctggcagcaaaactgctgggtttcactgccaggcctgccctggtcagacttgtttggggaggtggggaggactaatagcctgtggctagaaagctaaagactcccagtgttcttcctccaagttcctgccattcctctggagtaactgcctctcagtttgtttctttaatggatatccagcaccacaaaatggttagttttgacaattttgtccagctttatgctcattttttcaggataacagttgtcttatcctttcatagctaaaagttgctttaccccatattaatgtttttttgattatttaaatgatatgcaaaattaactatgacatagagtgtatttcttgtatattctagttgttgaccatagtccaacatgatacctaaaggttatttcgtaagcacgtgattggaagctttatgtgaatttatcatgagttaaagaacaaatttattattatattgtttcacacttttcattattctaatgactagatttaactaacttttaatacgttaccatgagtcaattctgtatgtgctaagcatgtttgaatta

SEQ ID NO: 11106 - DNA, 1156 bp, Homo sapiens
gtttgattaccaagcaaccacccacccatctagtccttgtgtaccccctccccacctccccccaacacaaaatttaatacgaaggaaccagtgagacacccagcaggagtacacagataatgtggggcagagctattgggggtgggagtcaggggtggagattacctgttaaaaaagagaaggtggaacagagaagataggtttatcttttcacgtgtgaatggtcactacaaagtatgggagtgcatatatattatattttgactcaatagtggccaaaagcacagtaatgcagtagcaaggctggctccagtcattgcagtagcgcctagcaaccacccagagagcagaacatggtgacctgctcttaagaaactcttggcctggtgaggctcatctaggaatttttgatctactctggtaatgttgaatttgaataccttataaagtagtaagaataggattttaagatgtgtacatttgttgacttttaaaaaatcaatttctttcagaatgaggaaattgaagcaatggcagccatttatggcgaggagtggtgtgtcattgatgactgtgccaaaatattttgtattagaattagcgacgatatagatgaccccaaatggacactttgcttgcaggtactttttcccccttccttgcagccatctttcagttacagtatgaactatattgttgacttctgtattctaatgattgtgttgttttctaaattatctttgttcttggcttttctcaatgattaaacacatgggcagttacatctcagatcactttcaaatcatacattaattgatagttccagtctttctaatccaatgcttttaatcatttaaaagtgttaatgtacccttgagagactgtagttttgcttcccttcattattctcttcatctggtaggagagggtccaaacctggaaagatggctaacatttaaaaggaaagagaggttagtaatgtagatgactcgtagaggagacagtcatttctttattaattgagaatcaatgatcaatgatcagttgtagttaggataaaataaatgaaaaggtcagctatggcttttcttagtgcttaatctttgatgactgcttgtatgtactttcaacataaaggatgcaaaacagtttttgc

SEQ ID NO: 11107 - DNA, 2038 bp, Homo sapiens
agaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggct

SEQ ID NO: 11108 - DNA, 2844 bp, Homo sapiens
aattcattcaacaaaattcactaaacatttaagttcccactctgacaagtattattctaggctcatttgctaatccctagcatattttggactatgaaattcatttgcaattgaatataatatcagaagaaattacagggtgatactgtatacctaacgatataaaaaaattttgtttattgtaggtacggctgcttttttgtggtatgacagtgttagaaatgattcgtttgtaatcttctttgcctgttatggtcaaactattatctaattatatttttaaatttatcttttagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaattttctcatttgtttctttaaattagatctctttgactctcttgtcttgtctggagactatgctgtgggtttttatataagttagtccagtataagcagactatatttgtattctaggactttatcaaaattctcttgccatgcccaagttaattagaattaaccgttcagtaatcagcatgttgtgtaggctgtttgttacagaattctttctccgaaaatgaagtccataaggctataatcaagatgactgaattagataaatgagttgaggagacaaaattgtactgaacccaacctggtgtagtacgttatctcatttgaaataagctcaactgacattaagaaataatttgtcttgccaacccatcttctgttgtcttattctccttttaatggaaactaaaattgcaattttaa

SEQ ID NO: 11109 - DNA, 1108 bp, Homo sapiens
tagtcttttctgttaagctcccggatgataccaaggacgcactagcatcacctgcaaacttactagatctcattagctaagtatttaggataaatctacatgcagcctgtacttcggcctttgtgatcttgtccacccctttgatacacacacacctctttgtttatctcttgccattcctcctctccctccctcagctgcagccacactggcctccctgctgttccctgctccctgaggcatgctcctgccccagggccttggcactgtctactctgcttggatcactctgcctcaccccatactggcatgactttctttcacttgttgcacaaatatcaccttattagacaggatttttctgaccacaatacataagatagacctcgcatccccaatacctaataacacctgaaatatgtgtttgtgaaatacatgtatgcatgtgtttactgactattccccccatttcaactgtaagttccatgtcattttattcactggtatatggccagtgcctggaagagctcctagcacatagtagacacttaatagatactcattgaataaatagcagaaaaccattcatttagattaaaacttaaaaaattcaaaatcaggctgggtgtggtggctcacgcctgtaatcctggcactttggaggccaaggtgggtggatcacctgaggtcaggagtttgagaccaacctggccaatatggtgaaaccccatctctactaaaaatacaaaaattagccaggagtggtggtgggtgcctgtaatcccagctacttgggaggctgaggcatgagaattgcttgaacccaggaggcagaggttgcagtgaaccaagattgtgcctctacactccagcctgggcgacagagcaagattccgtcttaaaaaaaataaaaattcaaaatcagatgccagctgctttatgcctctcacttaaaaaatatatgaaattactggctaagaagatttattttttaatctattgtagcacttatatttatttataatggagaaaacaataggaaaagaggttttgaaaagttccccaaataggtgattccatcctgagcagctgctctctggagcagtag

SEQ ID NO: 11110 - DNA, 1208 bp, Homo sapiens
ccattggcaagtttcagagagattggacagatacaagtccaattctgctcaactgctcgttgaggctcgagttcagcctaatccatcaaaacatgttcccgcatctcatccccctcacctctgtgcagtgtgtatgcagtttgcgcgaaagaaaaacctactctccctggtctgtcagcaccagttttgccgtagctgcttggagcagcactgctcagttctcgttaaggatggtgtgggtgtgggagtcgcttgcatggctcaggactgtcccactccatacaccagaggactttgtgtttccattgcttcccaatgaagaattgagagagaaatacaggtgctacctcttcagggactatgtgaagagtcattactagctccagctgtgccctggtgcagactgcctcatggttgttcgggtacaggagcctagagctcaccgagtatagtgcaatcggtgcaacgaggtcttctgtttcaagtgtcatcaaatatatcacgcacccacagaccgcatcaccatccgaaaatggctcaagaagtgtgcagacaactctgaaacagccgactacagtagtgctcacactaaagactgtcccgaatacaacatctgcattgagaagaatggaggctgcaatcacatgcaatgctccaaatgtaaacacgacttctgctggacatatctaggagattggaaggcacatggcagtgaataatatgagtgcagtacttacaaggagaatcctgacattgtgaaccagcgccaacaagcccaggcgagggaagccctcaaaaagtacttattctactttgagaggtgggaaaaccacaacaaaagcttgcagctagaggcacagacataccagcagattcatgagaagattcaggagagggtcatgaacaatctggggacatggattgactggcagtacctacagagtgcagccaagctcttggccaggtgttgatacaccctgcagtacatcaacccatatacatattacatggagtctggacccaggaatgagctgtttgaataccagcaggctgagcaggaggctgaaattgaaaacctctcatggaaagtggaacatgcagacagctatgacagaggggacttggagaaccagatgcatgtagccgagcagtggaggagaaccctgctgaaggatttccatgacacctaagttgggatgtggatgtgc

SEQ ID NO: 11111 - DNA, 1211 bp, Homo sapiens
acaaaaaaagaagggactagagaaaacaagatcagcccatcattgaaaatgattaacgctgaggatgggtaccatgggggttatgctcttctctttattactatgtttgaaaaattgccttaatgaagtttttttttaaagaaatggtaaaataaaggtcattcagtagaaatgttaactcaccacttgtttgtcactgtattcccagtgtatagaacagttcctagctttcctagacccacacacattggttacagctaatcatcatgaaagtaggtgtccaggtctgaacctttgctatttaaactgcatattcagggcctatagacaaattttaatgagcacacttcaataagtgaaggaagaacaaagtacctaattggagttaaatacaatcagcaatgaaagaacatttgtggaatttaatgttgcctcatccttggtaatcgttcgtttttatttccttctgcctcccaaccttgtaggtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctatgtaagtctttaaaagccactctgttgtgcttttgggaatctgagtgcactcctggagatgtgttactatggtagtcattgatttcttcacagttattctttaaccacactagagcactttgagggtgaatagggaaacaactgatgattggcaaatcaccaaagcataatataagactcttcagaattttgttttataaatgtatatccttttctggtttcagtaacttaggaactattggcataaacttcactggtattcccattttgatgagctctgtgagggcagcatgctgtctgttctcttcactgctgtattcccagtgtgtggaacagagccttgcatgtagtaagcgctcaaaaaagatgtgttgcatgactttgggttatgggcacaaggttttttacaaacccagtttattccaatcaatcctgctttgtacattcaacttatcagagctccgcctccctgatattccccgcttgccttgtttcttcg

SEQ ID NO: 11112 - DNA, 2510 bp, Homo sapiens
aattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgtttttgtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaccctttccccatagatttttatttctctattatattttacaaggaatataactcagtttgttagggagagtgccttaaaggcaggtgtttcttggactttgttatttaattagatctgcttgcaataaaaaaagttgtcggttatctaaaattcaaatttatcggggtacttggcattttcattgtccaactctggcaaccttgttcctaaggaagtgaaggttgctctctgcccagagtaacactggagaaatctgttgggtctggcagaagaaggctagtatatctaacccaaagagatgaaatcattctaccaatgtttgagaggctgttttaattgcttgttatagtttagaagggaaaagatcagagttgctgctataagagaagaaaaacaaattttcttctaggtccccagctggggctctgtaaca

SEQ ID NO: 11113 - DNA, 1092 bp, Homo sapiens
ttacgttaaagagcccggttaactatttatgtaaaagtatttacgtaacataaagcataatgttttatttattaaagatgtctaattgtaaaagtgcaaaataattttttcaggtggcatttcttgagtagtaaaattgctaatttagaataatggtttagagattcttaaattatgcacaagaaccagaaattgtaaagggcattaagtgctttaattataagatgaccttgaacacagtccttatcagttttcctttttgaacatgttttgttgcttttttgttttttcctctaaaactataggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggactt

SEQ ID NO: 11114 - DNA, 1228 bp, Homo sapiens
acagcatatggaaagctccactaacaaaataaaacttatattatttttaatgactttttttttctcgccacaagtaatctatatcctgatgtatttgaagtagagcagaaatacaaattatttaaatgtgctgatgtaccaatggactagatactgttttcttctatgttattaaattataaaataatatagtaagtaaatttaaacagtgtatttgaaaatcctgaagtatatttattatttgtctatttcatttgggtctaattattgtaatcatttgatcatgatgcaacaagtttgaaaaataatagaaaaaagtcagatgggggccgggcgcggtggctcacacctgcaatcccagcaccttgggaggctgaggtgggtggatcacgaggtcagtagttcgagaccagcctggccaacatggtgaaaccccatctctactaaaaataccaaaaaaaagaaaaaaaaaaaaaaagatgatgaagtgtgagtacatttctatttttttctctcggtctgctccatgaagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatatgtaagtagtgtgcactattcctgatattgtacgatataattgcacagtcatagcattgaaatggtagcagcgttatgtccctaaatctgagagaactcaagaaccccaagaatatcatctttaactccatcgtgtcctcctggggagccaggacacagagtggcttttcgttcccctgggtgcttccttacacagaggtttgaatgtggtgtggtgggaaagagagcctggtttctgtggtcaagcacacacagatttaaacttgggttctcacacttacagttccaggacttataggttagtcacttgcatctctgaaggtgtattccttgttcactgggataatagattccatccatagagctgctgtgagatcacatgtgctctgtgcctgctgtgtggtaggtgcataactcatcttgactcctgcctgctctcccccagtgatggtttggagggccacaaagccctctcttctgctgtttatcttcttcctaaggtgtgcatt

SEQ ID NO: 11115 - DNA, 1577 bp, Homo sapiens
ttcattatgttggtaggctggtcttgaactcctgatctcaggtgatccacctgcctcagcctcccaaagtgctgggattacaggcgtgagccaccgcgcccagctgaaagggatatgttaatgtgactttgggaaaaaaattaaaaagaaaaaaatcctgcaacttacattttcctcctcccttagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtatagcgtattagtatctgttgattagaaagtctggtttcaaaatatttttttattcagagaatgggcatttggacataagaaatttcaattcagccctgctgcagatagagaaatgggagcaaggttgtttcaatgaatatctcttgtcattggagaaggagggaagacagggtgtaggagtgggtggcagggagtacaagagccagggtcagtcaagtctggagcagatggggtccttgtgccattgacagctaccatggtttgttccagtctcaatctcggcactaatcggagcagactgcaccaaagtggggagagatcaaaagaccccgttttcagac

SEQ ID NO: 11116 - DNA, 1203 bp, Homo sapiens
attttttagatatacttatgtggtaaaatcatggatgaaaatgatacactttaactttggaatacctctgggaagaagtgatgccagtgggggcgaaggagagtaataagattgggggtggtgcagagaggacatcgactctatctgtgatgttttttttttattaaaaatatttgggatcataggtgaaagttgacatttgttaaattttagtatacaaatatttgttatattagtctccatgccttttctgtatatttgaaatgttttatataaaaattgcttgtggacacgagggaaaatacattctttcagagtcaggaggaaaagaacatcagtattataagcaaaatccagataagctaggattaatgagaggatatttttcactcagaattagaaataggcaagagtgaatgtatatatatatatttttttatttctgtaccttatgtctatttaaaatatgttttatttgagggcaagtcttcataaacgtgttgttaacaaattttttttaggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaaggtgatatacttgaatttttatttctgttttttatttgttttacttacagcatgatgaagataatttattgtttggcacacataattggtgctggggatgcaaaaataaattaggaactcataatttactgagctgcatttataaaaccagacaagggggactcttctacagctatttgcaatgtgatgttggaatatacaagagggaatggcattctttagtacagagaaattggggaaatcttttcaaggaggtaatgtagtattacaacagaatcctgaatacgtggacatttataaggtaataaaggacagtctaggcagaaatgcagagctatgaaagcaagatgcatttagaagatcgaagctgagaatgaggtgtgatgtttattaaagttattaatttaggccttttttttaatagaaccaattacagtggaagtggcttttagaaaccctttgaaagttctacttttgttgactgattt

SEQ ID NO: 11117 - DNA, 1012 bp, Homo sapiens
tagctgggactacaggtgccgccaccacgcccggctaatttttttgtatatttagtagagacggggtttcaccgtgttagccaggatggtcttgatctcctgacctcgtgatctgcccgcctcggcctcccaaagtgctgggattacaggcgtgagccatggagcccggccgtagctgtattttcaaggcctgttgtttcagctttgttcttaaaactcgaggcttaaatttaccctcctttctattactgatgttgttgctcagctgtccagatgtagcttattaacataatatccacaggccagtctggaagccaagatgggctgtgtgagtcataaaatatattgattattttagggcaataacagcctaaagatatctccatttaaattgagtcattattagcattaaaactttaaagttgtgcaaaacataaacagtgggcgttttgaagattctttttggaacagaccgctttgctattcaatgatctgactggagattgttttctcggtttggactttgaatattataatttaccatttacaatatttttccttctactaaaggataatataaatttgcaaaatgttaaattttttgtttaatctttttctttgttaaagtgaataggaaactagcaactggaaaaatagtcataaaatagcattacaagggctgaacaaattgcctttcctctctttactgttctttgttttgacaaatctatgtccattgttctggctgtgggcagaatttccatattcctccttttggcaaacttacttggtccccttccactttataaatgttaaccagagtcctttctgcagtagagattgtgagcgttaataccatttgtacattctaaatgaattactcttttccattgaaattaagttggaaaacgaataaatgcaaatgaaccttctgtattttattatcccatattgaagctacattttcagacatgttgaactaggtggtttatgctgatttttgtttgtaaac

SEQ ID NO: 11118 - DNA, 1100 bp, Homo sapiens
cgttaataatcttgtatgggagttggaaaggaaaattttggaagtcaagaaagtccatttaggccggacgcggtggcttacgcttgtaatcccagcactttgggaggctgaagcaggcggatcacaaggtcaggagttcgagaccagcctggccaacactggtctctgtgaaactccgtctctactaaaaatacaaaaattagctggacgtgttggcgggcatctgtaataccagctacttgggaggctgaggcagaagaatcacttgaacccgggaggcagaggttacagtgagctgagatcgcaccagtacactccagcctgggtaacagagctagactccatctcaaaaaaaaaaaaaaaaaaaatccatttaaccaaattgtcttacataatactgtaacaaaacaaattttgtgttagaaaagtatacttaattctttgactttttataactgcatacataagaattcaatatttttcaaatatttatagcttatttagaaatatttctataatataagcaatttcttaaaaaccatcagatgatacttacagtataagtattcacatccagactttttagtagaaaaccctaagggctttgatatcttttttgattgtaacattttaaaaattatgaaataaaagtactgaaaaccagacacaaaatttatagctgaatgccttattataaggaaatactcttttaggactcagccagtcaccccacgtgtcctttttgtgtcctgtcacaattacaaccccacaaaagtaactgctagactgatttaaatggtaatcactttgttgcatttgattactgctgccacacctaaatgcatatatctatattttaatattatcaatttaaagttgttattaaatgtatattttattttacatctcttttttaatctagaagttcctccttctttccagttccttaaaatttacctggtgaagaacctgatcctaggacctatagagtttcccatactttgtattttgctgattgcacactcatggcacggttcagcacattgccctgtcctctcgatattagcacacagtgcaggttcaggcacattgaatttgag

SEQ ID NO: 11119 - DNA, 1090 bp, Homo sapiens
tttcaggaataatcataaaaagaaatgatcatcagactgaaagtccagagcctgagaaatgaaaacatatttttaagcattggtgttgaccatgcagacaaacttttgttaattcagagcgatacaaaaggcactttgaatctataaaacttgaaaaagttaaaaattgtatgtcggataaagctttaagtcatctgtcactattaacctcagtgcagcaattctgactcctgtgcctggattccttttatgataattttgccacctacaggacagattaggtgctggtcgcctgaattattttgtgttctgaattattttgagctctaaaatggtaaagtacaaatactcattgttttactgtgcctttggccttttataaaaaggtatttataattcgttgataaaaaccaatatttgaagctgttgattaccaacaaaaaagtttcactctctttatagtgcttcaggatacaactttttcagggccttattagagaaaaactgattcacatgttattcttctaaagctaaattattaaaatgtaggttgaaagattggattgattgtgaatctacactaaagatatggttccaggcagacctccttagagacctccaggcagacctccttactgtcttcagtgatgtttaatttcattactgttactgggtgccaagtgtctttcatttggaagtgaacttactccagttattgaatgtttatcatatcataatttgcatttttccaacattgaaggtattttaaaaagtcactaagagattcattcttttattattcaactacaaaaaaatagtgtaatgatcagaatttaaaatgtgtgattctttttcttctgtaagtatgtattgctatgataaataaaaaatggcaggaccattgtttttattaaaatatctactgtgtctattcttaaacattaatcttgattactattttactcaaatttaataatgctttttaaattttcatcattgagcaacatctatcacaaaggtgtacattcatttaggccagtacttctcaactgggggtaattttgtctcccagcagacattggcaatgtct

SEQ ID NO: 11120 - DNA, 2194 bp, Homo sapiens
ttaaagttcaggtattcaaatcttgtatcttaaaagatactgttatatatgttttacataactgtcctgagtgtgtgtaatgtgtgtcaagatgtgtaatgtgtatcaagatgtctaatgttttgggcaaagtattagagtagttgaatatgtttttcctgttgacatgaatgttattgtttttagaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctt

SEQ ID NO: 11121 - DNA, 1108 bp, Homo sapiens
ttccctgcgattctgcagtgaaaagtgatgcccagagatccacacacagaacccttctaaccagccaggtcaagacttatcatcttatctcctctggcaggtcccctgtaatcaaaagagaggaagtgtctatctaaacaagacccttttgggtccttagattcatggcaaaaatcatcatggcccccatcagaaaagaaaatcagcaataaaccaagccaagcaactaaaatgtataatgtggacctgactcatgttgggaggcagaattcagacactcacagatcaatcttgcaagttttctcttctttaagttgagctgctcaactttatgaactgtgaaatttacttacattctttcaacccacatatatcattgcagtttatgaagttgcagtgaactgcccattcagctaaattgcagtgtttattcttgtctcatgtcgaaatacaacaatcttatgggaaatattatgacagtccgttccaactgttctcagacacatgcataaacagtctctgctcacattccacagccacctgcatgttatccatacagctccctgagaagtccagggatgggaggtggggtgtggaaggatggagggtccttcattttctaaacactttgtataagtcactactcatcgtgcctagcaagtataagattaacattttgaataacaaactggaaaacaaataatccttcaaagaacctagcgaactgttcaaaggaaattttaatttcagtctaccagaaaagttaaatctgttgttggacgtagggggctttcagaaacatgcctcttatatcaatttccactatctttcaagttacctaaaggcaccaggctgcttgagcaagaagaataaaaggcctagagtgcaaattatgtgaagtagagtttttagattgtgggattgtaataatacgggattctcatggttacatcatgttaaatcacactgttcagtctttaaaacttggtgttttaaaatttgtctcattgtgatagccagaaacaaggaataaacgtgatttcagtttaaactatatacaaatatcttctgtaattttgctgctctaatttttaggctataaattttg

SEQ ID NO: 11122 - DNA, 1211 bp, Homo sapiens
aaaatctttaaaaaaaaaaaaaaaacacttttgaacaagtcccttctttcaggagggttgactttagacaattaactgtgttctgtgctctgtcattcagattgcttcttgctaattgttttactcttgtgcctgaaaatgttagtgatacgaattgacactttaatgttgtatgcttggtggggatctttttatcacaaggcattttccaagagtcatatgttgataaagggatatatgttgtccttagaaatcacacaaatcatgaccacaataatttatctgtaactgctgctaattttattgagcagagaaaaaagaatatacatatataaacatgtataggtgcatacacaatacacccggatatgttttacacataattttgattctgatattttagataacatctgttcacttttaaacaatctgttgaggttttgggactgttatctacattgattctcttaggaatagtggacagaatgactccaaagattctcagaaccctgtctcttgaagctcaatcttatttgggttcatcactgaaaacttagaacaaatcagtaaagaatcctgtattgaagaattaagtttgagtttaagcccactcaccgcagggctggtttttgcatgtaatactcccatgatgtctggggaaatgacagtttctgttgaattataattctccggtttaagggtctccttcccctggtgtctgatggtgagaggtctgaagagcatttgtcagagtacattaggcattctcaacctacttcatgctttacgagagctgagaaatcagacgcaccggcctttattattatatatgctacatctgttgagtatttttaaaataccaataagaggacttgtttatttcataaaccacttcttccctctctttcaaagaaaatacattattaccatacttttacattagtctgagaatttttgctaaatatgattaagtattccaaaatataatggcgtcattattcttgacttttttagagaatatacatcttaagactgtattagttctcagagcaaggcatcatctactcccctgcacctgagagtctggccccagattccagatgtgcggacagcccatgaccgaggtgcacacagtgccctcttgaataggaaggtcagccagtgaggcggcagcataacttgcaggatggacttatatcttaccatctctt

SEQ ID NO: 11123 - DNA, 1456 bp, Homo sapiens
gggaatgacaacttcggtcatggaggaaacttcagtggtcgtggtggctttggtggcagccgtgctggtggtagatatggtggcagtggggatggctctaatggatttggtaatgatggaagcaattttggaggtggtggaagctacaatgattttggcaattacaacaatcagtcttcaaattttggacccatgaagggaggaaattttggaggcagaaactctggcccctatggcggtggaggccagtactttgcaaaaccacgaaaccaaggtggctatggcggttccagcagcagcagtagctgtgtcagtggcagaagattttaattaggaaacaaagcttagcaggagaggagagccagagaagtgacagggaagccacaggttacaacagatttgtgaactcagccaagcacagtggtggcagggcctagctgctacaaagaagacatgttttagacaaatactcatgtgtatgggcaaaaaactcgaggactgtgtttgtgactaattgtataacaggttattttagtttctgttctgtggaaagtgtaaagcattccaacaaagcgttttaatgtagattttttttttttgcacccatgctgttgattgctaaatgtaatagtctgatcgtgacgctgaataaatgtctttttttttttaatgtgctgtgtaaagttagtctactctgaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaaacaaagtcatggaatggttataaaagtgattgttggcacatcctatgcaatatatctaaattgaataatggtaccagataaaattatagatgggaatgaagcttgtgtatcatccattatcatgtgtaatcaataaacaatttaattctcttgaatgaaaaaaaaaagaaatatttttctgaagaatatatatttgatataacttctggtacaatgaagtatattttataatttgattcttttgtattttatgtttgttttatttatcacataataaagttcaaaggaagctatgtcagatttgaaactgacactgaaaatccctaacgtttgacttgtggctcagtttatcctcttgaaataaaattgttgggttttatgtgacattaacaccctgatgaaaatcactccttaattttgttagttgaattgaaacataaaagttcaagtcattgcaccttagtgcattttcttattagacacagaagctgaattatttacctgagccagcctaataaggtaaagggaactgattgaagaagaaaataaaaccgaagtcaccaggcacggtgg

SEQ ID NO: 11124 - DNA, 1206 bp, Homo sapiens
aagtctgggtcaccgggaagcaagagggagcgccactaaaggtatcttttgtgccttgtatttagccaccgcattgccaggatgggagtggaggcggacggtgcccgacaccacgactcagggagcgatacctgagctcgctcggcaattcccgggctccggggacgggcctgggcggggaaggagccggggcgcgcagcagcacccggcgagactgcagggcgcccgagtggtcggacgggggagcgagagctaaagcttgcggagcgcgccgagccgcgggcgctggcggccccggccggggagctgacgcgagcctgccgggccgcgggagctgcgggaggcggaggccgagctgggggcggagcgggcggcgcctgggaggcggaggcggtgtctcccagagctgcgcaggcgttgctcgcaccttgttgattagtcagtgctgggagcgctgctatggcgtttctcagacccgcggctcctcctcacacgctcgaggcggagggaaggaggggtaagaggaggaggaggcgagcgggcggccgccgcagctgcagacccagggccagaggaggaggcggagcgggagccgccgcagccacccgggccgccgccgccgcccgcagccgcgcggctgctctgagtcttctccgggcgtgagggcacgcggggcgccccagccatgccccgcagcggcagctgagccgggcgccggccccctccctccgggccgccccagtcgccgcgcccccccggctgcccgcggccggagctgcccggcgcctcccgcgcgccccagaccgcgagcgcgagcagcggcggccgccgaggcgcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggtgagtcccagctggggcgcggggcagacgggcgaggacagccgtctccacgcgggtgtgcgcgcgtgtgctggagagggtgggacccgcggggagtgggctgcccgcccctgagcgccggagttggcccgagcggctgccgcagccctggcgcgttgctctcaactccccccagcagcagacaaggaggtgga

SEQ ID NO: 11125 - DNA, 1097 bp, Homo sapiens
ctacccacctttatgtctgagataccatcatatccaggaagtctttagtgactcatagaccagatttaggtatccctgccatgtactttgatggaaacccgcatttttcctaccaaagcacttaccacactttactgtaattactgtttagtatatatgcatatcctattagcccttaactctgggagggcaatgaccaggtctacctcaatgcctagcacatagcaggtgctcaataaactagtagacttgaattaacctcagcaggaagctcaggattgaggagacaactggcaagggggcagaatgaggcaccattcctcaggtactattttactgcctcagatattattaaactaatagcataattcaatattttcacaacctccaaattcaacatttcagatagttgaataactctcagcacatgcctccacctgacaaaatacaaatgctcttgccaggcacatttgccatcttataagaagctctttcaggatctctgccccaatcctggcattactgtgaaggtgcccaatggaaattatatctgagttggcagagagtggagtgaaggggatattgatgagtctcatccagaaatgggttaggcatttcaaggaaatatctaccattctttttggagaagacttgggtaacatttttcttccatttaacacttcaataatcataacaaacatctttgtgtgcatgtcttcttatagtaccgaactgggagggaaggacagaagttctgctctcaggaaacttttcttttctgtggagtctcacccctacagtgaactccttgcatttcacaattgtacaactcttacccacagagttaaactctggtgtgtgttctctgatgctgcataaggcctgacctatgcctaaatgtttttctacattcactacattcataaggcttctctccagtgtgaattctctggtgctgggtgagggctgagctctgattgaaggattttccacattcattacattcataaggtttctctccagtgtgaattctttgatgttcaataaggatagaactcctaccaaaagccttaccacatgcaatacattcatagctt

SEQ ID NO: 11126 - DNA, 2469 bp, Homo sapiens
gaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattc

SEQ ID NO: 11127 - DNA, 1202 bp, Homo sapiens
tcaactatgaatgccattgcagattcctccctcttcattcctacatcaccctcttcctcttctacttggctccaatcctgcttcaggatcacctcataccctgcctgacactttcagtgtcctcctgacaactttgaatgactttgttcatcacggcatatctactggtcatttgcctctgataagaggtcagttctggtattggtctgcaggatccaaaagaaaaactcagacactttaagagaaaaacaattagctggacttgagaaatcctcttaagaccaaactcaggtccagtctgctctgactggagtttgactctttcttaatctggtattaggcatggtttaaaacgacctgtaacgttgaaaatatgctcttcagagccagaaggcagtccctgtaggtgagggggacccattttcccccatctcccaagttaaagcatggatctgtccaaattttaaatgtgtttcatgattgatttggcacctggtggagggctaaacatgtttgcagtaagaaatctcttaatttctgaatccatagtcattggaaaaagataccagatatttgttactctttccagtgactgtaaattgggagagtttaacttagtaaaaataaagggtaacgaaagaaatcaatggactatggaacttgaccccattatcaaataggacagatatcctggggagagattacaaattatgccctcttacaaatgcatgaaacaatagtgtcatttaaaataatattctatctgatgggaatgtgtgggccttatttggatcctcattcaaacaacaacaaaaaaaactttaaaattttgagacatttgggaatctgatatattttgatatttgataatattttggaattctcacaaatagttgtgattatgctattgtaatgttaaaataattcatatttttagagacacctactgaaatatttatggatggaatgatatgacatctgggatttgcttcagaatgatatgagagagaggaagtggatgagaatcgtgttgaaataagattggccatgagtcagttatagttgaagctgagtgataagtccatgggggttctttatactattctgcctttggtatatgtttgcatttcttcataataaaaaagctttcaaaaagaatgagatatttttattactaaaaattgtgatgaaatcttacccaa

SEQ ID NO: 11128 - DNA, 1193 bp, Homo sapiens
gaattcacaaatagactagtgaaacagggtagggtctagaaaccagctcatttttgtatgtaatcttgatttatgacagagcagtcactcatagttacagcagaagaaaaagggaccattacataaatagtggtggaacaactggttatccatagaagaaataaatgaagttggatacttactgtatatcatagttaaaatcagtcccttgaagattaaagtcttaaatataaaaaacaaaaaaaaaatttttttaattagttgagtgtggtgttatgtgatcccagccgtggtcccagctactcaggaagctgaggtgggaagatcacttgaggaggtcgaggctgcagtggcccctgattgcactactgcattccagcctgggtggtgacagagtagtgataccctgtttcaagggaaaaaataaaaaataaaaacacttactatacaattgttctgtagttggcattaaacaggaatgttttgaaagatttcttaacttgcttttatgacatcaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggtaattaatttgtcagacattttgcctaaagtgttattggcagaaggttgtggagctttgggaatcatatcaaatggataagtgtattttgagaaacgtgaagcattcgtataccttatggtagttaacagccatctttcacatatgtgagtgttttaaagaaggatttctcctctaataaaattagaaatttttgcttattctataaatctagtgcacatgagaaatgatgacatgcgtgttttttcattcctttatgaacattttgcaaatgcgtcagatctgtactttaattcagttattaaggataataatacttagcttaattaattgtgtcagtatgtgaagatactacctaaaactgggtccttgcattaaaatgtacaattttaaattcagacttgtaccatctggatgacagttattgactggtaaagttagaaaagcttgtgtaaaacataaaaatagctagaattgacacaaaatataaaaaaattcattaat

SEQ ID NO: 11129 - DNA, 1641 bp, Homo sapiens
caaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaattggcattttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcagaatttcaggtttttgtactccagcatagcttggtcttatttcttactgtatgaaagcttaacagcaatgtgatttaaggttttgttttaaatgggagatgtaagtgatttaattcatgggtacttttagaacctgatagataatcccattgcctttatttttctaattaaagaattcctaaatactttgaaaatacaaaatattcctgaatagttgtgccttacattggttttatttgaagttagagtggatccctgtttatcataattacttgtaattaggcagatgc

SEQ ID NO: 11130 - DNA, 1250 bp, Homo sapiens
taatgcttacatgttccagccccactcccggctcacactcttaggcagaaattcattgctcctgtaaattaagtaataattaataccgctaatgagaaatctgggagtacaggaggtgattttaaaaaatgctcgtatttcctttgattagagtagcaattgttagggatacatgagccagatttggttttatgtaaaaaaaatctttcagttgatgagttcttgtttaaattgtattgctgtggcaatttcttattgtaataatatgtaggagaatttctaatttgaatccctttatttacagaaagctcactgtaaatttgtaggaatgtcatggtactaccccattaagttatttttattagtgtttagttattgattcagcagtctctaattgtgccaaaaatggtgcttagattagattgccattgctacccatgggagctgctacttaattattcccacctcaaattcccagctctcaagttagcactactcctttgcaatttactccttctctgctcgtataaataccctcagatgatgatagttggtggccactatacctttgaagaggttgcccacttctacatggaaaggaaaagatggtttttttttttaaaagatgaatttgataattaacttgccactatttcaccttgtgatgaaacctcaattttaaacatagtgttaattgttttattgtccacagaattaagggtaagtaatgtcatacaatttttgtctttagtcttttagtatggtttctttaacttctattgagcttctgttgcagatattggacatgggcgtatcttctaacgatgtcgtcaccattagtatattcttcctgctaaaaataaatatcaaaccctgaagcctgtattgtctcatgtttttgaaaattgaagagaagactgtaactttattctgctttatactttctcacttatgatgatggtcatttgtcactgtttacaaaaacagaatttatatttgaagtgtaactgtagaaaatagatcagatgccactccccacaacccccttttcccccagtgccttccagccacatttcatagttgacagtcatagattatgaggctgatgataataataatgttaacattcatgtgtcaggtactattctaggcacttcacataagcaactcatttaatcttacacagcaggatgtattatccacatttgatagatacagaactgaggcacaggaagattaagtaacttgcc

SEQ ID NO: 11131 - DNA, 1509 bp, Homo sapiens
gtatgtatgtaatcatgttttaaggaattaactcacagtatatctagctacaaataaagctagtatactgtcctataaatttttctaaaaactaatctgtagttctaaaaacttaaatgtcactcttattttcccttacttttttttaaaggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttgacgtcagatgtctggttttctttttaaaaaaaaattttttttaccattggaaccatttttaactgtagagttcagtagttttaagtatattcatgttgtgcaatgaatctccagaacttcttcatcctgcaacactgaaactct

SEQ ID NO: 11132 - DNA, 1211 bp, Homo sapiens
agttgttgaatcttctgaactatcatgttggaaacattggatgtgctcttctatctagggaaaaatgtagccttcatttttgccacatgtgttgccagaccggacatcatatgaaagttgcaaaaaaaaaaattctgaaaatccagcctcacttagaagtgaggcaatattttcatctctttataaagctatttgtgattgcgttcttcaccaacaatttttttttgctggaggggtggtggtaggggcagtttgccacaaagctgaagaaacgcattctgtcaccaaaaaataccatttacattttttctccctttacagatttcttctttttctggaaaaaagtttaacatttaaatgaaaatttcatttgcctttttagtattaacgtgccgtgatatttagtctaacaacttgtccctgaatatctctgttgctgtaacactttaccaccttcaagacagcaaaggaggtgtgttttaagtgctatgccactggttttcaatccttgacctcagaggaaaaaataattctacattatgttttatgacagcttctctgtatgttttttgtaaagttaaatattctagacaaagtcaggtattatccataagatatcaaacaattgggagaactttacctgcttggttatatttatttcctcttttataaccagggaaacacaattaccacctcttttttagagatgatgaaagtgcttagaaataaagctccagcacccttaaatgcctgagctccacctattctacaaggctgtggggactctttggcatcctctgtgttgcatcttttcactgaaactttaatttgaatatttgatttttcaccaaatgtattttctttattttttccattgttaggataattacccttagaattctgtagcttctggagatatttacaaatatatatctgttaatctttccttaactctatgcctagtgctagtatttaaggacatgggagcttaggggctacttaataattaatgccttattcaattaaaaaattttaacctgtgttttcctgactttaaaaaaatacatgtttatcatggaatattttagaataatatagaatattgcttcattcccaaatcatcagtgtgtgtggtatattcatgtttttcatttaatcatcactgtaacagctagatgaataacagtaggtctcgtttgacattacagtga

SEQ ID NO: 11133 - DNA, 1281 bp, Homo sapiens
agtaaatgctgtctcctgttcatttttgaatataatccagatatgaaaacaagtcttgcctgaagcaatgagggagaaatagcagataggatctagaaacactggactaggtgagggaggttgaaagtgatggatgccacagattgggtagcagcaggtgcaggtcagaccctggacctggagtcaagaatggccctcatgctcagccctgccagctgattcatgctgcaccttgggttagccagggtccctcttcagagcccagggtcaccaaaagctgcagatcccagagctgtgagagcaggaggagcgggagaagtgtcaaaaacaaaatttgatttcagaacagtgggctctactgagtctgagaaagatgtcctagtagcaaagagagagagagagagagctaagctgaatggaaccaggatggccctgctgatgctgcttatccacttaaactgctctcttccttagcataactgagtcattcattcatttattcactcattcaaccaaatatattttcttcagtaacactttattgcatgccaggcagtactatggagatgtaagtgggtattgtccctcagatgttgcaagtggggtaccgttgtctatttgactcataagctgcagacagaaagctgtctgtagttctggctctggggcttttcacaaatgtttgttgcttcacccaaggtattggcagcttcccactggtatcagagctgctgcagatactctataagcagaaagcacctcgtagtatctcaactaggacagaggatgtcagagcttctcaaaaaataacttgtaattgaccgattaatttgactgagtaatagggacagtctgtgcctaattggaaggaaagtcaagaaacaccttcaagcagaacaaggtgagatgttagttgaaggcttccattctggtgtctatgtgaagacacatggggttttatggtactgatatatttaatctatgggatgtccttgaaagtcccagcataggaagaggaaggtagaatagtaagcttgacaagaaacctgaaaaatcatgcatcacacattttggaagacggaacagaatccaaaaaaagtagcagaggaaatagaagcagaaatctgataaattaggggaaggtcaaaacacctgaaaggcccagtgtattcgggcaaatcaggttcagaagtggaggccacgcgagagctgaccacttcatggaggaaggtaaaaactgcatccgagagagaatgtgtgcaaggggtggagggcagggga

SEQ ID NO: 11134 - DNA, 1108 bp, Homo sapiens
gggaatagaaacgggcagaggaagacagcatgccagggtgatcttgtccttgtgataattatatcttaccactgggaagccctaatagtatttatatccatgaccccattttcttaaaaattaatttttgggggtacgtagtaggtgtgtatatttatcatcactagatcctcactggaagaggcttagtaaacgtcaaggatcactgaactgaagtctgaatatctagatttctgggaatttggactaggcacataaccccaaaaggtttattttctcccatataaatttgcctttcttatccctgttctcacttttcccaaagttactaaagggatcaaataaaataatggatttgaaattgctccatgaactcaaggatatcaacatttatgagatattttgcatgttttgggggacagataagaagtgccctgcacattttgggattgaaaacatactgtggtagtggaatggttagagacttgctcaaagtgccacagcttgtttttagcagaatctttctcatggatctttatccaggaggtatttccattataatctggggttgcttcttccactgcaggaaatcagaagaaaaggaaggaaatcaatgagaagtatattcatgaggcagatttcataaatcatcaagtgtccgtggagctccttagatgcaatttctttaactcacaaaatagaaagataccccaagccttatccaaggtaatggtaattgtgcaacatggtagaatgctggcagtagtgcagagtcaatgacctaaacagagcctatgcacaaaaacaaatgacaagggtaatgatatttgttttgtgctttacagtttccacagacttttgtgtatatcagcatatttgattctttcagcaatcctataatatagggatggaaggtgtttttattatccttaaattttaaatgcagaacatgaggcctggagagttaacttgacttgtccaagattgaaaaacctgtaagaggtgagtctagagtcaggcctggatgttgagacttcaaattcttatctccatggtgctaatggcactaattctttatattaagccttgggcaaatggttcattatgc

SEQ ID NO: 11135 - DNA, 1153 bp, Homo sapiens
cctgattaactcttaatggtaaatatttttagcacttaggtaatttttatagtagcctccaatttaaaaccacaatattgataaaattgtaaaatatattttctcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggtcaaaggaaataaatttttagaatccatttatttgtactgaagtaaaagttcacatatgcaacttctatttaataggttaacttcacaaacctattctgtaccataggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacaggtattattttaatgattaaaagaaatgttaaaaaagatttggataattctaaggcattggttgagactaatggtatattgactgatttgctaaatgcattttactttttattatggaaaatttcaaatacatagaaaagttaggagaatggcatagtgaaaccccatgtatctgtcacccagttattgcatagagtagcatgtttcgttctagtttcatttttaaccactactgttctcccttctagataattttgaatcaaatagaaattatatcacttcatttgtatgtatttcagtataaatatgttgcctattatgtttttttctcatctcatgcacatctcctaattgcagcaataaaatatacaggtcaggtcgtgaaagatttggggtactgatgctttgcattgttaggttttgagtttcagctttttggcataatgacttaaatttgaagatagttgatttcttactttaagcttgctagcgtgcgtatttccttacattatagatcttcttggaaacagaattgttctacaaaggtatccgccctgcaatt

SEQ ID NO: 11136 - DNA, 1404 bp, Homo sapiens
gttttgattaatttttgaaactgtttatggagcttctcacacataaataagatgataatcaaatttgtcttaagatttccatttggccttcatcactttatttcatactgatcacccagcccaagaatcattgccaaagaaaatacagtggaaaaaagcttattaacctgtccaatttctttgcttctgtaatagttatttgaggatatgatagtgagcatattaggcttatcaatgtgctgtcctaagattattcaaaatagcaattttaaaagtcttaatcagagagggttgtttgttagttggaaaagtactcaagaataaaccaggtgaaaaggacaatactgcttccccccccaccccccgactattttcttatgtagtattggtgtatggggaggagtgcccattcagcttcattgatgttcaattgtgtcttttgtgcagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaaggtaggtttaatgttcgttagatatagttgcagcttctaacaaacatcaaaactgattatgcttagggtttttctttttattttttaacagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggtaaagactcaaaagcatattaaaagttctaactaaaatttgctcaatggaaggattatattttagtcttggaatggtaaatggtaatggggacattagaatctaatacgaggattaatagtaaaatttcagctgggaagtgaagggggccagcccctccacacctgtgggtatttctcatcaggtgggacgagctagctcagtcggtagagcatgggactcttaatcccagggtcgtgggtttgagccccatgttgggcaccagatgaagggggccagcccctccacacctgtgagtatttctcgtcaggtgggttgagagactgagaaaataaataagacacagatacaaagtatagagaaagaacagtgggcccaggggaacggcgctcagcatatggaggacccatgccgccactggtctctgagttccctcagtatttattgatcactatctctactatctcggtgtgggggatgtggcaggactgtagggttaatggtggggagagggtcagcaggaaaa

SEQ ID NO: 11137 - DNA, 1070 bp, Homo sapiens
gaccagatttttattattattattattattattattattattattattattattattattttgagatggagtttttgcccttgttacccaggcttgagtgcaatggtgtgatttcagctcaccgcaacctccgcctcctgggttcaagcgattcttctgcctcagcctccgcctcccgagtagctgggattacaggcatgtgccaccatgcccagctaattttgtatttttagtagagacagggttctccatgttggtcaggctggtctcaaactcctgcccttaggtgatctgcctgcctcagcctccaaaagtgctgggattacagctgtgagccactgtgcctggcccagattatttttttaattgaattgaattgtcttccatagggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaaggtaaattataaaataagattttggtgttttaggatctaagtcttctcagttattcatttagcgattcaaagattgtatcagatttttaaaaaactttgtcttaatttgcctcagatttttttcttgttattatcatagattgtaaagagaataaacttaagggtttgaattagccaagtttttttactctagggactgatttatacataacttgtagccactggctccaaaatataaaattgaataaactttcaccccaaatccaagaagtttaagtctgttctgtcttgctgttaagattattttatacaaaagcaaagcatttgataacttcaacaaaatttttctggtggaaattggaagtccgtgactttgtatttctagtgagtagacatattgttcaaaggcgagttttggtgtagctatcagaagctctctaatgtaagtctactttgtattgggttgagcctcatctgtcagggtatgagaaataagttgtaggagttaggga

SEQ ID NO: 11138 - DNA, 1245 bp, Homo sapiens
aagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccacctgcccagcctgttcttcttcttcttcttcatcttcttcttttttttttttttttgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgacctgttcttatgttaaccacatattttttttcccaattccacacagcaggtgatttcccgtgtgacatattttcttcatagtccctaatatag

SEQ ID NO: 11139 - DNA, 1149 bp, Homo sapiens
acatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaacaatgatatcttctgaggtttttttttttttttctttgtccctatctgcttcagttaattaggtggtacctggagcaatttccaagttaccttttaaatgtgaaagtggattctattttgttaacaagtcttatctttataagatgtctgagttttcaaagcaagagctgtatccttgcaaggttacttgcaaaactactcccaagaagttttgcaagtaaccttggataattgttggatgttgataaaaatagctttgcattagctttcctgtaacc

SEQ ID NO: 11140 - DNA, 1119 bp, Homo sapiens
tgcctcagcctcccaagtagctgggactacaggcacgcaccaccatgcctggctaatttttgtatttttagcagagatggggtttcaccatgttggccaggatggtcttgatttctgatctcgcgatctgcccgcctcggcatctcaaagtgctgggattacaggcgtaagccacagggcccggccaagaatcttttatgtgtagggattgtgagagagtcaaagatgcaaaacccagcccctacctcagggagtggtcaggcacctaggaggaggcagcaatgcatcttacatgtactaggagaggtttgaatatggtgactgtgtcagaactccaatcagcacatggcctgaccttggattatttaaattgcaaatatattcatatgaaatatctgaaaaaggtatataatgtaccccttttaaattcacatctttagcaaatatcctttaaagaaaaaaagtttcataaagctgagatgggaaacttgagattgacagttcatgtcatccctctttctctcccttccttcaacaagtatttatgggaactcgctatatgccaggaattggtctagacacacaatgatgtgtgtctttcagtgaggccaagagaacagacaaataaaaagcagtaacagctccctaatggctctgtgtggagcatcccgagaacccacaggaaggtgcttcataggaggggcagcaagtggctggaggggattttcctggaggaagcagtgtgggagatgtgacctgaagggcagcagagcagtattttgttagatgaaggagtggaggttgagctagggagccagggagaggttatcaggtaaagggagaggcacatatgaaggctctatgaaccaaatgtatgggaggtcagaggagggtgtcattaatttcgcatgagggcaaaggcatgagagatcaataaaggcttcagggaggagttgctatgtgatggggcattgtgagatgaataggagtttgataaacaaaggttgaaagcactctgggcagagggagtgggcagaatccataaatgcctggtctatttagcatgtgatgctcaggtaaccatgtctagagcaaagggtacaggagggtaggacttgg

SEQ ID NO: 11141 - DNA, 1210 bp, Homo sapiens
agtgtccctcagctcttgccgggcctctgactctccctcctctcttccagacgcctaccctgtatgcatctctttcaccaactgtgcgtggaccagtggctcgccatgagcaagaaatgccccatctgccgagtggacattgagacacaactgggagccgacagctgagggaggaattagccagtggacaccccatttccttcaccaggtccccccacggccatagcccttgcagccaaactttgccttctgagccatttgacgtagaggaaaagcctgcaagcacattttgtggaaagaggagttggtggtatcggtgtcgagggagaggagggggttggggaggacccacctctccagaatggcgactgtccccatccgcctggctgagcaggagagagggagctggcggtgcccagcgcaagggcgggaaggaggggcccaggctgcggagaacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaaattctgtttacggtgaaaaaggattttgtttttcacccaatttgggaggcgggaggggggggttctcgttttatttttgtttttgtttttaccttggcttttgtttttctcatgtttacagtgcacggagtgtggaagggggtctaggagagggagagctggaaaaggagctgatggggtcttatcctggcctctgagggttcagcggaggtgaggaaggcagcagagctccagcaggtgaagggagagttcatctaggcggggctccccaggcccagggctcaacttcatggccccagctatatccccccagttccacactaaaccagggagggctcggccctcagctactggtacccaatgtgttcctgggagccgagagacccatggtcactccaactccttcctttaggctgtg

SEQ ID NO: 11142 - DNA, 1634 bp, Homo sapiens
actctttgataaccttgggcaagtccctttctttctctgtgcctcagtttccttctcctttgaggggggagagagaacagtgcagccccatttccggtcctgctacctcacctagatgttgtgaggattcatattctctgtccagcgtgttctatgctctcttctgagaaccttgtggggtgtcgggatgggggtgctgggagacacagacctgatacagtatgtctttctgcaccacctcacaattttcctgaaccccaaagggagcagagagataagaggacagaagaatggagatgggaaaatccaccaaattccaacccaaacccaactttctttctccctatgtggaagacaccagattagctggaattctgccaccttcctttgtgccccaccccccactgttccctcatttgcactgctctgtaagcctccccctcacctccattcataacccagtctcaatgccctcgtatcaataagaccggggtaagggggacaggatacttgtcacatatttgaagaaattccatacagtgaaggaaatttgagtctgtattgctgctacaagggtaaaaccaggaccaatgggtaaaagtaacaggcgggcagattttggcttgaggaagagcttctagcacgactggttcatgcgggaatagctgctctggccacctgcaggcagaaagtgggggaagtggctcctggcaggagatttctcccagcactaatatcctggtgttctataaaatctttattgagtgcctaccggtgcaggcgctgggagagacaatagctttgaggagctcacaatctagctgaggagacaagacacatccaatgctgcaaaaatggtgaataacctgattcagggttagcagcaatgagtatcacagcgtccaactcagtagctccagtgtatgaaaatgtctccagggctaaaggctggagatctcaccagtggggaaagtacatctgagtcaggattttgggggaaagctagttactgatagccacaggaagttgagacttctgccccattctctccaatggctgggtgaaaaccaagaattcatcggaagatggctttggcctggaggtagctagggtggtctaggaagctcactcctctcttagtctcagtctttcattctttctgctgagactggcctgaaaggctggcaagtgggagggagtcagtggggaggccaggatagaactagagctggtgtcccaggttccagtctgggctcttcactgacaaagtgggcaacactagaaacttccctttgtctctctgggccttagtttcctcagttacaacctaaggaggttggattggatgcttgctaatttccttctgacactcacactccctaacatcaacacatcttcaaggcggcagagctgtgcgcccacccagctattgaaaaggactttctgtgggcacacactctgtttcagactgggctgggggcacacgtgctgggtgagacagtgggccctcgtcccctcccccctcccaattctctgccccaggctaatattagggactggggaggggaccaccagaggggagagggaagctgcttactttgggggtagaccctgaagcccctcctccttccccc

SEQ ID NO: 11143 - DNA, 1094 bp, Homo sapiens
agccccccgcctgtaggcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatatagtgactgtatttagcacatatataaatataatttgcacttgtcagcagactggggtaatcctttcacttgctacacttggcacccccccgcccccaccacaaccctgcctctccatcatgaacctgcctttcctcctccctcgctcctcccacaacctcagcccacccagccggtatcctctgaggaaagtcttggggcactagaggccactgtctccacctggcctccaactccagaattggagccctccagacattacaagaggaacatcagagagccaaaaagcctgacttcttagaaggagccctggactggggagccgggaggctcaggttttcaaatctgctccatgacagacgtcccaatgaccttgagcaagtcccttggcccctgagtctcagttttctgggtggggtgagtgaggagaactgggagatctttagggtcccttagattcaagtagaatgtgacacagatcccgtgggaaaccactgtgctgtgctgtctcac

SEQ ID NO: 11144 - DNA, 1853 bp, Homo sapiens
aaaaaaaaaaaaaaaaaaagagggaaagagggagaaaggattgggaggagaaaaggagagcaaagaagaagagaagaatagagagagtgagctgagaatttgagcttgctcagagttgactttcgggagggtttttgtcctataatatgtggcatcctgtgggtgacagggaggtgagttaggtggacacgtataggacgtgccctttcataaggcttgggcagtcatttggcgagtgagctgaaatccatgtcttgttagagatagggatggggtaggcagaaaggagctccaaactatgggtttgggattggcacccctatcctatcatcacccagagtcttcattgttgagatgctgcccatggaaaacagattgggacatagattttggaatcaaggtctctgctcctggcatctcctctgtgcgtctccctctgcctttgctccctggggactgtgggcaggaggagcttcttcggaggaccgggagtgggcctccagtccccctgcccctgtagaggaataatgagggaggacatggggaagtcactgtcaaaggctggcacagctgtgagcccaatgcctctgagcgaaaaggagagagagggagttcacgcccctgagagtagccccctgagccggctgggacctggactgcctgctttcctcctgcctcttcccctttccctccttcacagcttatcctccttcttccctctttacatcactgcctttacctggtggggatgaggccccatggggaaggtgctgatgtggagggaggaagtggagaccgagattcgccatactgcccagggaggctgtgtgagaactgggctgtgtatggtccctaaagcctcaactctgccccagctgggcgatgggtgcccctctctgggcttcctgcctagcttccccttctgcctccagcctggagccttgctttccctggagacaagcccgtggagtcccccaccacactggagggagcacgaccaccacactgctgggcctggcagacaccacatctttggcagggctcctggacgggcatgccttatgctgctctgcagggtcagagtggaaaggggccctttgccctggctggcctgtgccctcacccttgagcccctccccccactccacccctggcctcggatgcggctaatttctcagccatggagccagctgcaccagccctcgagggggtaattttgttgcccctggcaagtgaaaggattatcctcagtgttgattgtccttttttgtaatcctcctgctgttctgttctgttgtgctgtgcaacattttgctacatagactattttatagcagaaagctagaagaatatttattatgaatattaaagcaatagtgcatcaatgaaaaggcggagacattaggaattgtgtaaatgcttagattcacttttggtggattttttgtactttatttataactaataaaaatgaactgcattgctaactacaccttatgcctgctgggtgtttattttggtgtgtacccagggcatgtcggaggaagcctcgccaggcctctgtctttgtccaagataagaggcactatcagttatctatctagctctcaccaacttgccttgttctctctcctttttctcttattttcctcttccctttctgcccctctttcacccttttcttccccccccttcttgtctcttatctatttctttcttgtatctctttatctcttaaagaatctgttctatgactgtggaccaatcatctaattgacctatttcctgaactttaggtatgaattgtaaagcggaattttttttttttggttggagtgcagtggcacaatcac

SEQ ID NO: 11145 - DNA, 1236 bp, Homo sapiens
tgcagtgagccgagatcgtgccactgcactccagcctgggtgacagagtgagacatcatctcaaaaaacaaaacaaatcataataataaaaaaagaatgtgaagcacagtgcctggtagggtggaggaatggatgggtggcaaggagacttcaggcacagatcagccctggcagaggacagcagagaggacagtgtgtgtgacattgctgggggccaccctgctgggcacagagctgtgggcgacttgcccagatggagatggcccaggtccagggacttggagaaccaggtagggggcagggggtggggaggcctgtgggtaagaaagtgccccggaatggaccaaaggtattaatgagttttaatggagctctcgaagcaatagtttcctcagatcccaagtcctctgaggaaagccgagccagcagggcaggtaaaggatggccggaaagctctctaaggtcctggggtatgttgttgagccaggccagcactaccccatcgatggtaagccaaaattcacaggacacaccagcaacaggatggtaacgggttcctcctgtaccagcagtggccgagtcacccacagatgccacactctgcagtgagagccctgtgtatctcttgccagaaggacagggcagagaaccagtttggactctgggctgcacactcatctccaggtcctgacagggaatggggaggctgagaggaggcagtggattcgagggcaggacatcctgagaggcctgctgtggggctgagcgtgcgccctgcctcctggctgcccttgaatctgaggcaagcgactggggcttcaacagggctatgtgagatggggtgtgaccatacacggcagacaagctgcctgcccactctggagacatggctgggatgagatgggctggccccggtcacagagaggtgagtggcctgaacggctggagtgtgtcagagagaagggtgcccgagggcctcttgtggagtgtctcagatcctaaacaagaggacagtgtggagggtgaacccacacaagtgctcatgaaagtctaaacacctgccaggtctggaaacaaagacactagccacaatagcagccctcagacaggaagctgcctgctgccttcacctctcttcctcccgcaggagtctgaaaccctgggtcaccaaaaggcaggaggaggagggacagggcaaggcaggggaagagaggggaggctgactcacatacacac

SEQ ID NO: 11146 - DNA, 1106 bp, Homo sapiens
gatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattggggcttacgttgtttatctgtcttgagcattagtactttatgactttggccttatggcaacatcatgattattaatccgtcagcctttaatgtggtcactgtttcttatccagaccctgactttctagtagtttattttgctagcccagatttctgcttaaccaaatataagggagtttcagaggggtgatcttagctgtcacctagattctgtcagccaaccagtgattgtctggaatatcttaggaaatgaactgtaattgtcagcctcctaaaatcaatttttttttttttttttttgaggctgagtcttgctcttgttgcccgggatggagtgcaatggtgcgatcttggctcaccgcaacctccacctacagggttcaagcgattctcctgcctcagcctcccgagtagctgggattacaggcatgtatcaccacgcccagctaattttgtatttttagtagatacggggtttctccattttggtcaggctggtctcgaactcccgacctcaggtgatccgcctgccttggcctcccaaagtgctgggatttacaggcgtgagccaccgcgcctggccaaaataaaatgtttttatctttcttcacttagaactatgaaggccttttcttgttctggtaaccccccacagtgtaattggtgctgaaaata

SEQ ID NO: 11147 - DNA, 1113 bp, Homo sapiens
gttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagattttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcaca

SEQ ID NO: 11148 - DNA, 1148 bp, Homo sapiens
tagttttcttctctaggtttatgaagttaattttgacctatgatttattttttttctccccttagtgaggtctttattttaagcacaatgcttatcctgttggtgaaagtttatgttactgaaacaattgataattggctcggtataattttgccacttgaaatttgtttagattatgtgaataaaatttagtggaaaagaatagacattttatagtatccatagaaaaaaatggcttttaaagttattctttgcttcttagatatagttactccacatgtaatttgggagttggtattttaagaagttctttgtagacccagctagcacaaattgtaaagtatttgtaaagtatatacaaagtctaatgccaaggtacaggtgaggattcatgtcggtgacaaagatggaaattcagagattcttaattcccaactgccttttatggctgtaacatgggttgttggaagagtgtctgcatgtcatctcagtatgtgttataagcaagcattctgaaaggatttgtttcctaaagaccttgaattaaaaattaatcctgaaaaaaggtaatgagcatttctgttcattaaagtgatcctaccatttagcagtagcatagacacaatttaccaatcacttgccctgttagtttttcagttctctgaacctggattaatttttaattgggggaaatttacattatttcagaatttgggcataaagtgagactttatttctttttagaaatgtgcaaacttgagaaaaatgcagtaaaatatgtctgaactggctatttggtaaaaatgtgtttcaagctgatattgagcaaacaagactaatatccaaggctgatatttagccagtattaacagttatggtgatactggttgttattattgaaaagctttcttaccagttgataactgaatagaataggatctattttgctttagaagaattgctagtttatcatcatgtatgaattatgtagcagttactatatctaaatagtttagttttactttgattttattgttaatgtgctcttttgtgattagtaatttggttttatttttatgcataatttttatgtagttagtcatactgtgaagagttttggtattgataaacttaataatttataataa

SEQ ID NO: 11149 - DNA, 1205 bp, Homo sapiens
tacattgtatattgggaggggttggttttgaaaaggagtatattcattggtgatagattttatagtcataaagcaaataactgtttgcattagagcataatcagataatgaagtggttagtagaaaccaatagactatagattaccaaaattaagatcttgtacaacaaaatataattaacaccgtaacttgaatgtaatttttacgggattgtcttatgaatggtaatgattctaagtggtatgtgaaatgctgttactagcacatgccaattgatagaatgctggaaaaatcacattttacattatattttagataggatttttgtatgcttgagggtgacttggcttatgtttttttttctttccttttagaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttaggtaagtgtttgagaattcagtttcttctgaacaagatagtaaatgaaatgagagaccttcaactattgattaatgatgtgctgttaatatagtgaaattgaggcatcaatgccgaatgtttgaatatacggataaaaattcggcaaccatgactgaaatctaatagaagctttatttcatatcatttgatctttcttcttctccaattcttttattgtaaaatacacataatataaaatgtatcatcttgatcattttaaagtgtacagttgagtggtgttaagtatgttggtaatgttgtgcagccatcactgccatccatctccagaactcttttcatcttctgaagctgaaac

SEQ ID NO: 11150 - DNA, 1159 bp, Homo sapiens
ttaagggttttagtggctcagagccccagctgtagagcttttaacacctgtggagcttttcaaacaacgaaccctgaacctcacctctgtaaattcatgcgttagatttaggatgggttgagaagactgaactctgaagttatatttatttttacctgccatttttaatttttgtgtagtaacagatgtatacaagttttctaagttcttttttttttttttgttaatgaaaactttccaggatttttattagactcttgtgaatgttgttggccaaagcttaatgtaaagcgaagaatttactcgctcttatagagcagagtaaaagcagtcagtgctcagattggagtgcaaccagcaactggaaagtgatagaaaccaaagaagcttttttttctcttcctttctgccttcctctctgttttggtttgtggatcagcttcatcctcttttcctgtaaatcagctgtctttacttcttgcatttttagaagatggcccctctcccacaattcatatgacgtgcccaacagagactaactggggagaattttcagaggagtgaggggtgcaggctgggcacatgcagtaagcatcatctgcttttctttgccttaactgctctgtgcagacccatgttaccctacacttgaagatgaactgtaccccgcccttacatcccattacagacagtaatgatgatgatggtatatacccattttaatatagtggttattccatgcctggttctggtctaagcattttttctatacttatttaattctcacaattttttcaagaaattgaagcacagagaggttaacctgacctaaatcacacagcttgagatttgaaaagctaagatttttaatcttagacatgtagcttttagagtctgggcttttcagagcccgggctacactactttgttctggtaccttggggtctaggtggagcttctagccatcatcctgcgattgctcctaaattaaatgattggtaacatccttcttgtgtgacattataataaaggaagaaaaacagactaaaaaacggaatagaaagaaagaaaaggggaagaaataatcttggattctcaaaatgatggtccttggatcagaatatattgtggtggtcagagtgatgctcaagtaaattat

SEQ ID NO: 11151 - DNA, 1249 bp, Homo sapiens
aactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaagcacttgtttttgtaccttagtataaacctgtcagtgttaactgcattaatctccattttgggtgaacacctcttattatatgttctttgctgtaaaattgccgagtatagagttaatgaaagtaaatatttacatgtatttttttttcttcagtgaattaactgaattgctgacatacatccagaagactcatgagcaccttttatttcatgacttcagttacttctaaaactatggagcaggtattaagtaccttttggcctttcctaagttagagatcagtgatctttggactataggcttgcagctagtccaaggaaagtac

SEQ ID NO: 11152 - DNA, 1336 bp, Homo sapiens
aaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacatatgattttaagagtacatgtttttgtttttttaatttggtgttac

SEQ ID NO: 11153 - DNA, 1315 bp, Homo sapiens
aatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacc

SEQ ID NO: 11154 - DNA, 1251 bp, Homo sapiens
agatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaggaaacatgaataaattggaatccagtggtgttggggcttttgtttttattttgtaaaggtgatgacttcttataa

SEQ ID NO: 11155 - DNA, 2249 bp, Homo sapiens
ggttttctcatcaggatgacaaggggctggaggagctggccttcaaggttccatccagttgaaagatctgtaactccaggacgttgctgaggctttttgaggccctaaaagcagactacccaagctattaagggtccctttgcatctgtgctctgcagagaagaggctttgttggccaggtgggcacagatgctggtgtactggactcctgatgggcaggggcctggagagaagcagcacccagcgcttcctatgcttaaagaaaggcagggtcctggtcaaagggctgtaagagcctgggcaagtccaggactagcctcaccgcctccttctttctgtctcgtcctgagagatgagctggtgactgggtgcagtgggggggcgggtgtcttcattctaggagtcaccaatgcctgtccccactaaccctctctgccaatgtgttttctagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtatttt

SEQ ID NO: 11156 - DNA, 1525 bp, Homo sapiens
gattaaaaaaatacacgatttttttttttttttttggcagaagaaaaggagaggaagaccagcggggctttgcaaggaaacggggggatgtaactcgtggatacatttttccacccatcaaacatcttgttatactttgtaaacattttctttttttaaaccccagttccagccggacgcccccagacctctgaggttcgaggaggtggtggttttcatttggggctttgcatatttggttgttaggttttgcgagagccttcttattttgccagacgtctcatgcggggtgaagtccactcggccccctcccctgagtcttcgtgtgcgcggaattcgaggagatccggttactaaggatatagaggaaaaaaataaatcgcttgcttttttttttttaattgcctgcttctccccacccccaaattaagttgcttagcaagggggaaagaggctttttccttcttccaacagcccagccgaacgcctttcgttttttgcccccgcggaccttccatgtaggaagccgaggctggcgagcccgacattcgggagccactgcgggggggcctctttttggggaggcgccgacgggggcaggctcggccgtccccagggaagcggcggccgggttcctccggggcgcgccggggccggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaaccc

SEQ ID NO: 11157 - DNA, 1251 bp, Homo sapiens
aaacagtctgtaatgttcagtgcagatgcaactatccttgttttttcctcagaatattttaaatccatggttggttgaatccagggatgcgaaacctatggatacagagagccaactgtgtaaatttagttttgctttttatttataagctgtggaggccaaaagaacctagctgttaaagtggtcatctttttcaattcatatgactgatcagaatcacaactcggatagttttaaaataagctgggagactccctttcccttccatcttaacgttttgataccaaattattttaccttaataaagcgagtgtaacactgcctccctatagtgaatgcacagacttctctacttatcctgggcctggacacaacccaactcagtgtcaccaagaatccaaaattgaagtcaaaaaaagaatgtgtcttgtggttccaaaaccatggaagaagaaaaaatggattaaatggttaaagaggaagcttagggctcattggcattcccccattccttgttttagacgtggttattatcggtgggtgaaattagcctcagcctctctgtagacctccagcatgtccttgttgctgctgtgacgtgggtttgcagggtgaatttaatcaactccaggcttccttactgccaggccaaggctgccagcctcttgaaagctcactcgtttcagattttgtttttttgggttttctaattttttctaattgagggcctgaagccattatttaagacttttccaaacttctcttgccttcaagtgttcatttgactattttatgggggtggggggaggtggtattgtttgtgttttctaagcaaaccaaaattacatattttttaatctgtcaagttaacctttgacaaaagtttaccttaattcagtaaacatatttgtactttggccaattctgaattaacttgaaaagtgttaagatatttttaaatttttaggcataaatatagcacatatagagttatgagaattgccttttagtttacttaaacataaagatactcatttcaagtttaaaatgtaaatgatcttgtgacgaatgaggctattcacatttcagatgaacttgtttcaatactttgaggcactttctatttgtcataacttccctgagattgagtcactatgttttactcttatttatccacgtatgtgttcatttttatacattacattttcccaactctaaatcaaaactgaatgccaaggatattttgttttt

SEQ ID NO: 11158 - DNA, 1136 bp, Homo sapiens
ttgccagataatgtgttatgcactaaatttataatagctcacagtgttataccgaatgtagataaagtaactggagttcaagagttcaagtgggctgggcacggtggctcacgcctgtaatctcagcactttgggaggctgaagcgggaggatcgcttgagtttaggagtttgagaccagcctgggcaacatagtgagaccttgtctctaccagaccttgtttctccccactgcagaaaaaaagtatttaagtaatttgatcaatatcttatgatgtgataagaggaaaagcaaggattaagcctcaaaattgctctcaaagcccatggtcttcactgttgtgtgcagtgctcaatttctgtgagttgtgccaatagcccttttgtattaacagatagtgttaatggcagaattatttctgtattgttattcagaattagatgactcccataaatatgagtttgatttttttttcctttttgtatagtcttccatacaccagcaaacttgtgaagaccttattatataactttatcagacaagaaaagccacctcctccaggggcccatgttttccctcagcagtcggatgggggaggactgctttatggacttgcatcaggagtagcaagtaagttttatcagattttttcaattctttggtgcacataaattttatctatttaggcataagaaattctgtttgcttggctgccaccattaatagttacattgaatttgtgcagctggttcaatgtgaaaacaaagtaattaaaatattaatctttctgttttgtgcggtgatttatgtaaaatgtatgcaaataatgaatggattacctacaaaacatcgtttttcaggaagaatgtttacacataaatatgcgtattgcatgaattgtagctgtatagtaaaaataaaattaagcatttgaaaacttataacactacttgtattataagaggaaatctattttaggttattttagggtatattttggttaggatttcatgtgactaattaggtgcagttttcctattacactaagtgctttcttcagtgacaactgaatattttgcagaattttgtaataagctgtgaaatggcacaaacttgagttttgtttgattgggtgc

SEQ ID NO: 11159 - DNA, 1202 bp, Homo sapiens
aagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaactggtagttcattttcttttaaagtctattgaaatattcaaaagggaaatttttcaccacgtcagaaggcagaatttggatgttgtgatggcatctgtgtagtggtgggacaacaattactattgttgcgtaacaagacactccaaaatttagtggttttcagcagcagtgactcgactgggcagttctttgctgttctgggctcactcatatggctggctgggcctgggtctggacctgggccgctatgtgatttttatcttgggctttgaaaattcagtgtagggacctataaatattcaaagatgatgagatgcatccttatatattttttgtattcactctgaagctgggaaagattaaaaggaactcctgcccttgggtccctaatgaagtctgggtcctaactcaggctctattaagttctgtggctggtcaagtcactgatttaccttgggctttatttgatataaatcatgtaaatcagcaggtctcagcttttctgtccaaagc

SEQ ID NO: 11160 - DNA, 1202 bp, Homo sapiens; identical to SEQ ID NO: 11159

SEQ ID NO: 11161 - DNA, 1267 bp, Homo sapiens
tttatccagttacctcctcttctcactcctttcccgtaacacacacaagcttctgtatgtgtttcatataccctaaatctactctataaccctaaatccactcatctcctttttagtttgcctccctcttctggtgtttgtttttgttctttgttttttgttttttttgattaaaaactttcagctttccaaagtctgttgcctgttgtaattataccaaaattgaggactggggaaaagattgagcagatgagctgaataaggatgagtaatgcagatgtgatgttattagttctatttcattaatctgattttttattagagtagatttcagtcactgctttctttttcaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcagttaatattttcctgtcatttatatttttaaaaattttaaattgtgataagatacacattacataaactttaccatcttaacccttttttagcgtacaattcactggtattaagtacattcacatttttatacaaacatccccactttttatcaacagaactttttcagtcaccacacatggaaacaataactcctgattctcccatcccccatcccctgacaaccaccagtgtattttgtttctataaatttgatgactcgaggtacctcataagtgaaattataaatatctgtcctttcgtgactggcttattttactttactttatataatgttctcaagattcatccaccttatggtgtagcatgtgtcagaatttccttctttttaaaggctgaataatattctgctgtgtgtataaaccttacttccttcttcccagcttaaaggccatctttcatcctttattttctccctttaaaatg

SEQ ID NO: 11162 - DNA, 1099 bp, Homo sapiens
tggaaagtgttggaagaatgaagtggtttcctttttatgagtcacctagattgaactagttcttgtaaatctctgttcttgttcagatacatccattaatgggataaatttttcttttgcctttttaaagggtatgtcctttattatctgctgtacatttatgccaggtattaatatctgttgattttcaagatttatattgtgttaagaattactattcttagccacatgtaggtagggcctgttactcaggcaaacatgattgaaaccttttagttttctcctcctacatcttggtaatggatactttagcatttgctttacagttactttaaaagcatttccttttgagacactgtaagctacagtacaatatttgtttgatttaccattaatttgtaaaatcagtgtgtttcttaatacattgtttgggtacggtaaaaggagtttttattactgtttgtttttaaataggaaatttgtgttaaagaagctgaagttgttttatgtggaggaaccgaaagcatgagccaagctccctactgtgtcagaaatgtgcgttttggaaccaagcttggatcagatatcaaggttggaaccataaaaatttaaaagaattagttcttattagcattatataagtacttttaataacatacctttttatgggagagaaaactaattttgaagccaatttcgttgatgaggattggcaagatatgaatgattagaagtttgtaaactatttcaaaactctattttggtggttagttttgacattttaacccatatgaaattagattctatctatctcagcagacctctagtagtataattatcctgtgtaagtggccataggcatgggagagatggaggaagggaagaagtggattaaaaagatagacaaaagagtgaattaatctcactactaaacaattagtaatctgagtaattaaatctttaacgtgacttatagaagttttatttctgggacagtctcagaatagatttcttcatcatcacagaaaacatctttgaatacagattatattgtcccaaatcaaacaaaaactgattcttttatctttgagagctacaa

SEQ ID NO: 11163 - DNA, 1184 bp, Homo sapiens
gtaaagtggatttttgaatctggcaaagacgaatatgatcatctcttgacatgttggattatccattctcctttcatcattacataattgatatcttttcactttccctaaactttgtaggttgaaaggttgagtcttctggactcgcctgtctgctagactgtcttgaaaaacctcaaagcaagcaggctttcttgaagggaggagagaagtgaaattggaaggaaatgtggctatttttctcttccaaagtagtacagggagtaagaagtgggagatggtctcaggaatatgaggcaggatacaaacacttgagggcagaattttgttggcagttgggtcaggagaaatagactcttgttgccttgtgtatttcccggttgatatgtgtatttaaagaggaagagtggagggcattatcttagaggaacacacttattacaatcaggcagagcaatccaaatcagcctgtataacaaacagttgaggaacttaatttcaaagctctgaatctagttataaatgattgttttatctcttgcaaagacagatctgagtaagtgtctgtaggcattgattaagtgacttcaagcatcaagggagataattaaggtggttgaggaatagtctgttctttcaaagagttagcagttgacttggaagacaaaaattccatgaagagaatatatgaagtgcctcgtgagcaatccccagggcaccgtttccctcagcaggtggatggagtgtctctctttgacttctggagcctcggtgcagcccaggcagaagagaagggttcttacatgcaagaaatcactgagagctctggaatactaacccttgaggctgctattatttatttatttatttatttatttatttatttatttatttatttattgagatggagtctcactctatcgcccaggctggagtgcaatggcgcgatctcggctcactgcaacctccgcctcctgggttcaagtgattctcctgcctcagcctcccgagtagctgggattacaggtacctgccaccacacctggctaagtttttgcacttttagtagagatggggtttcaccgtgttggctaggatggtctcgatctcatgaccttgtgatccacccaccttggtctcccatagtgctgggattacaggcgtgagccaccgagccctgccac

SEQ ID NO: 11164 - DNA, 1233 bp, Homo sapiens
ctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacga

SEQ ID NO: 11165 - DNA, 2257 bp, Homo sapiens
caaaaacacgagtatcgatcctttgttttctgtctgcaactcattgctttctactctcacccttcctagctagcgctgatgtgtgtgtttggagagcataaaacaaattaattttccgaaggtcagaagggataattctccaccgtaatttgcacatgttaaacttgggggagcaggcactgacataagaggcacagcatctgatggtcttatcaaatcaatccatcttctgtctcttccaggggagtgctacgcacagcaggagggtggctgggcagtgcaaagccccggaatcccctgagcaagcagtgtttcagctggctggacagatcaaataacacttgggctggttaacaaaagacgcaagtgggaaggtgttggaagccggagtgtggaaatttacccaacgttatttctttgacagggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaaggtatgtctggctggaatggcggatactggtggtccacagaatccccaagaatacttgcagcattcccaagctattcctagctccatggtagtcagaggactagagttagtaattaggggaggctggagggtgctaggaagatcactagcctgaaaagttgttggaggcgtggagggagatctggttcttggtcttggctctgctatgtggctttgatcaccctgagctgtgcctgcagaagctggactagacgatctccaaaatttcttccagctctaaattctatggcttgaaaactatgtggttggtgaatttgcctctagcatcttcttatccctgctgtccacttagccatcccatgtccttcctgtgtgctcaggacacaccctgaggcttcccaccctgtgagcctcatgc

SEQ ID NO: 11166 - DNA, 1180 bp, Homo sapiens
catgagccaccgcgcccagcctttttttcctttttctttccatcttgctcagtgccccagcctggagtacagtgctgcaatcatagctcactgcagcctctaccacccaggctcaagcaatcccacttcagctgctgcggtagctgggactacaggcacacaccatcacacctgtctaattttttgaaaaatttttgtagagatgggggtctctctctgttgcccaggctggtcttgaactcttgggttcaagtgatcgtcccacctcgacctcccaaagtgctgggattaaaggcatgagccaccacgcctggcaagtagttttcaatcttggctgtacttttagatcccttgaggagctttacaaaatactgatacctgaattctagccccagaaattatgatttggttggtctagggtgcagccaggttagccctccgcagtgattgagtcattagggtcctctgactttttcttttgaactgtttcacttgtgttagctttacattctttaatacagtgttacacacatgtacagtgtagccatctcacacatctaacttaacgggtcttttgaaagtattgccacatttgctttgcttctgtgtctgtctctttcttttctctcccccttcctgtcacctattcctttctcctctgtttctttcttcactttcagtttatttgaactgtctggtagtaagttttaggaagctgtatttcccatgatgagaagttagtatatcatcactattttaaataggaagttgattttcttttaaagtatattctcaaatgcttacttgtactccttttggagactaattactttaagtccccaagttagcatctgaactccctgtgggcttggtctggtggctcacatctataatctcagcacttcaggaggctaaggcaagaggatcacttgagcccaggatttcaaggccagcctgggcaacaaagtgagacctcatctctaaaataaataaataaataaataaatataactcccaatgcaaattgtcttcttagggcgttaatctacttggtaaaccttacattttcaagcccccaattaactagtcacttaactggtttctgagaggcaggttgcattgggctttttctgtcagggcttaattaatacactgtgagacatttgctcagctaggccag

SEQ ID NO: 11167 - DNA, 1204 bp, Homo sapiens
ggtaaatttttcataaatattagtaatagacttttaggtttaactagtgctgatcctcataagtaatcctttaaaaaagtgctggtaagattttcctttagggtgactagtaaagtcagtaagacttgattgagcatgccactatcataatgagaagacctaactttaatatttttggaatgtcaaaaacagtgacattttaattaagtaattttatttttaaaaattatttttaatggctaatattttgtaagaattttaagtaattttcaactctgagcatcaaattttaattatgtgcattgaatctctgacttaaccagagcaatttcatcttttcccaagtagtcagatctacttcgtaaaatgtgttctgatgtgtgtcttttttttttttcttttttaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctatggtggcagatttaaaaacttgctacgtttcctttcaagctactacagggtaatttaatttgtgctccatctcttcagatactgtgcatcctgtacaaatatgcattatgggaatttctggaagaatatgcaaaagataaaatcttaaagttttttaatgttctactcagaaaaatgttcaatggagaaaatttggaaaataaaaataaaaagcagaaaacccacacttcgcaagaactacctttagcactttggtattcatttttgtagcctgttgttttcttttttttttttttcctagacggagtcttgctctgtcacccaggctggagtacagtggcgtgatcttggcccactgcaacctccacctcttgggttcaagcaatcct

SEQ ID NO: 11168 - DNA, 1999 bp, Homo sapiens
tcaccctgtccctctgatgtcttccaaatcttttctgttaggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatc

SEQ ID NO: 11169 - DNA, 1091 bp, Homo sapiens
ttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttc

SEQ ID NO: 11170 - DNA, 3206 bp, Homo sapiens
cctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaacttgaatgtattctccttggtgtttttcatataatcatcagtttatactagaagattagttaacagaatcgaaaattttcttttatagactccctattccccaaccagctatctgtgctcactcttgtagttattttgtgtgtgtgtgctcttggttttgaatgtgtcgcttatgttcctgtccaagtttagttttttctttaaatgagtgttaaattacagtaaactggaaatttggctggttgtagatttagttgcatatttgtgtagttgaccacaaaccactactgatctaattgtaaatagtta

SEQ ID NO: 11171 - DNA, 1267 bp, Homo sapiens
tatcagactggctgaggggcaaggcagaagtcaattgatacgattcagctctgtgtccccatgcaaatctcatctcaagttgtaattcccagtgttaggggagggacttggtaggaggtgatcggatcatgggggcagatttccccctcgctgttctcatgatagtgagttctcatgagatctgatggtttagaagtgtgtagcacctcctcccttgcactctctctctctctcctgccaccctgtaaagaaggtgcttgcttccccttcgacttctgccatgattgtaagtttcctgaggcctcccagtcatgcttcctattaagcctgtggaactgtcagtcaattaaacctcttttcttcataaattatccagtctcaggtagttctttatagcagtgtgacaacagacaaatacatcaatcgactacccagtggctccttaaggagcatgaccagctgaactgctgtattgtggagtatcagaacaagggccaggctaacaagtgcatccagcatcagcatgggttacaaagaaatctcatttattttgctaccgtcacagacaccagcccaaccagtacttcaaaagcaatgagacaatcttccagttggctgttgtgaggagtaattgaatgtaatccatctcttagaaaatggagacaggatttttaccaacttaattgcttaaaacatgaacgaaagccctatggctcttttaaaaactgtgagtgtgcaaagaaagctaacttaactgtattctcaatgtaaatatttattttaatgattaagcaaatccctcaataaggtgaccccaggtgttctctttcctggatgtggagcatgtttggataacaaagacatcactggcatctgcaagcctactttttagtttcaacccaaagaggaaattgagtaggcctcaggcaggaattggtgggactcctgactgagcccttgctacatagacaggtaactctgtgctccttcctaccagtttgtcaatgccttgaaataaagcttacttttccacacaatcctccttctcctaatacttctcctcctcctttcttcccaataaaggaatctgatggaatcaagaatgtaatgaagcaataaaaggcctaattgaagctgaaagccaattccatccctgaccttttgcaggaacttattttggtcactgaagtgttgatgttgcactacagtgttatatcatgccctggttaccaggaagaatatctccccaacctcaggacaatcaagg

SEQ ID NO: 11172 - DNA, 1148 bp, Homo sapiens
agctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgtta

SEQ ID NO: 11173 - DNA, 1195 bp, Homo sapiens
ccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaa

SEQ ID NO: 11174 - DNA, 1126 bp, Homo sapiens
atctgacactaatgttgtgtacaatctagtttgcaactctgagagacaatatcaaataagtactgtcaaatattcctcccagttaacctttactgtcattgttctttgaaattgtctttgggattggttatgttctctcgctgtagctttcgtttatctcagagcacaaaccctaaaatccatgtgcagtctccatgttcaagtatagatgtctgtttcaggacaatcctgggtcgcggtagtgtttccctctctgtagtgtgtgtttggtgtcatgcccttggaaaggctggccaaatggcagcgcaatgcaggagggtgccacggtcaactttctctctggcgaacttgcttccctttcaatctggtcactgctcatggtcgaggtggaaatcttgagctcagtgatgaacttggcttatcttcaatctgaaactgcactcttatgtaaccgaatccatttcttcaccaaaaattaaatagcgctttcaaaagctgtcaggcatattcttaggaagtgtcctgagacggagctggagggtcctggccttctggctctggagggagtgctggcacagctgcttctttctgggccaccaggaattcatgaattatttgttctatttgtggcctgaagatgtggtttagttttggatccaccacctgagaactaatcctgtccactccagcttctgacctccctgactgaaccacactctgcctcagaccatcgtgcagttggttgtcgtttgctggaggattccattcctgcttgtccagatgtgtcgacacaaaattatccgctttctggctcaggttttggtaagctggcttggtgtccacgtcagccttgcagtcccggcggaagctgtcaaaaaggcccctgctcttgagctgccccacgatgatagcgatgagctgagggtcgccagggggcaacgaggccgggttgatggggccgccgcccccgctggcccgggtcgaggccgggcccgcaccgccgctgccgccgccgccaccgtccgccatggctgcgcaccgggcccacaaggaaaccgattatagcttcttctccaggacagaaagcctagaatgtgtagaggtggctaagggggcggtgaaggag

SEQ ID NO: 11175 - DNA, 1167 bp, Homo sapiens
accccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggatta

SEQ ID NO: 11176 - DNA, 2120 bp, Homo sapiens
tttgttttggccaagttatatgttaatttcatttgaaaacctgtttaacggccggcttgttgattgcaactgagttttaaaaaattgatcctaccagtatctagtacccttcttcattttcctcttataaatagacattgacttattttaaaagtttttaaaaatctcttctttccagggtagtacttattccctggttgattttttcataccaaattatttctttatgcatggttcatgaaggcatagagattaagtgctgggattacaggcacgagccactgaatctggccatagttgaattcttaaccacagtgagctaactcctttcatggtggaaaattttaactgtcttagatgaaagttttaacttaagtatttactcctctttctttctttctttttttaaacagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactctttgctggcttaattttcttaaagctaaacatctctttgtcacattcgttcatgcttttgcaattattttatcttttttatgatgtatatatgtgaaattaagtactactaaatttagtagatattgctaacgttatatggtaatgagaacgaatgattttttaacgttagatatgtgggtcatggttaaatcttttttgtaatcttttttgtgttactgttggacacattagattttatcctgttttgcaattaagtgaaatgacaggtcaaaatgaggcatttaggctgggtgcagtggctcacacctgtaatccctccactttgggagaccaaggcgggcagatcatctgaagtcaggagttcaagaccagcctgagcaacatggtaaaaccccatctctacaaaaataaaaaagttagccaggcatgatggcaggtgcctgtaatcccagctacccaggaggctgaggcaagagaattgcttgaaccccggaggcagaggttgcagtgagccaagattgcaccattgcactccagcctgggctatagagcgagactgtctcaaaaaaaaaaaaaa

SEQ ID NO: 11177 - DNA, 2122 bp, Homo sapiens
tcagtgagccaccgtgcccagacacaaatatcttttaaaaatggaaacgcacaggctgcgcatggtggctcatgcctgtaatcccagcactttgggaggccgaggcgggcggatcacgaggtcaggagatcgagaccagttttgccaacatggtgaaaccccgtctctactaaatatacaaaaattagccagacgtggtggtgggcgcctgtaatcccagctgctcgggaggctgaggtaggagaatcgcttgaacccaggaggcggaggttgctgtgagccaagattgcgtcactgcactccagcctgggcgacagagtgagactccgtctcaaaaaaaaaaaaaaaagatatttgtgtgtatgtgagtgtgtatttatccagaaagaacattggtaaaaatatcaatataaaactaaactaaagctgagaattaggaggttcttaaaaatctcagcttaccaaaactttgacataaattaaaatcctcaatactgttaattttttatttccttttccctctttctctggaccccacttttaaaaaatgcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagtaagtatgcattcgtcagcttttgcaaagaatatgttttttgccgttttgaaacttgaatagtggtgctcacgatagcattgatttattccttctttgcatttgaacaggttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtatgaagttgtctttttgttttatttctttctaggtaatatctttagagaagaaatcttagtgtaggtaaattatgtttatgttttaaaaaaaaccaactgatatattaagtggttaatggaagaacatataacaaagttttgccaccttagatcgtagctaagttctcttttttcactttgacttgatcttttatatataaaggagcaaacaagaaattgctactcagtggagaagaggggagtccacagctaatttgcaaagttgggaattggtagcattgttggcattttatggacagcttcccaatgttaaaagccttgctggataaaaaaccagtgcaggagaaaagcagtgctgagctattgtctcgttcttcaggtacactcacgtggaagctgagtgtcctttcctgacttttgacgacctcctgaaccggttggaggacttggtttgtgatgtggtagatcgaatattgaagtcacctgcagggagcatagtgcatgagctcaacccggtaggtgcagtgtttatggaaagaaaaagtcacagtccttttttggaagacaatgaagtcttcaccctcagtttttgtagatttgatggcttggtgagctgaaataagtgactaattattttgaagactagaatttgatgttagtcactgtcaataattttataatgttttcagttatataacaggctcatgttttccattttaggaatgtctacatagttttctagtctgaagttatatatatatatatatatatatatattttttttttgagacagagtctcactctgtcgccaggctgaagtacagtggcgcgatctctgctcactgcaacctctgcctcccagcttcaagcgattctgcctcagcctcctgagtagctgggactacaggagcccaccaccacccccagctaattgttgtatttttagtagagatggggttttaccgtgttggccaggctggtcccaaactcctgacctcaagtgatctgcccacctcagcctcccaaaatgctgg

SEQ ID NO: 11178 - DNA, 1184 bp, Homo sapiens
gtggagatgggatccaaagctagttttggctgatgaaaatacaggctcatgccctgtatgtgaggacagtgggacagtaatttaaacagaagtatctagaggagtttccttattgccttgaatgtatttctttttaacattgctatggacatttaggaaaagatgccactgatattccaaaaggggcattccatacacctgagagggatccctgaggctccagggtcacctgggccaagccaggtatacacacgtctcatggcaagttggctgttatcataacttccctggtgttgttttgttgcaagggcagcattgtggggctgtggtttgaattgcttttttgtgtctcttgaatacacgaagttcctcctatagtcattggctctgctgcctctgatgaggcacttccgtgttccccacatttgaatttgctcccgattcgagagaggcaggcatccgcggcagcagcttccaacccagacaggcttaagccgcgcgagggtgcccgggtgggtggctgcgcagggccctacctgggcgggagcggctgcagagccctgtccacgcggtgcctccccagcacggcacctcccactccaggctgttggttacctggccgggagctggcggagaccaggatttctcctcgccgccgttgctgttgttaggggaaacagaccatctgcatctagacctgcctctctctccgctccccacttcagacgagctcttcctgcctggaatctggtaagtgccaccgaaggttccgttccctttattactcgattagtgcccacagcatcaggagaaggttctcttaccgtgaatccattagctttaacccaaatgtgcaggattagggggattatttgaacttgcttgctttctttttaaaatgtccattagacattttttgcatgcttcaaaatcaaaaggcggcacagtgaaaacattttaattatttatgtatttaacctgtatcatcttgtttctaacctcttttcttcagggtggtgcagtcaaaaattacacagatattgctctggtgcctctccccccttttatgaataaattactgcatttgtcatcactgtgttcctgaaatgtcaaaaatagacactgtaaaggaatctgtcatgcagagttcagaaattttcaaatttctgagttcaaaacctcag

SEQ ID NO: 11179 - DNA, 1183 bp, Homo sapiens
tccagcctgggtgacagagcgagactccatctcaaaaaaaaaaaaaaaaaaaaagagttaaaaacatgcaaattcttaggccccacctctgatcccctgatcgactgaatcgaaactctggggtggacccaacaatatgtagcttagtaagccctccaggtgatcctgatccacactggggtttgagaactgtttccccacactacagcttcaaaatatcttgaggaaataacttctcttagatcactcttagccacacagagaaatacttcctgttttatgtctaaatttatcttcctaaagctttgaagggtggagcacactatcttcagaagtgtagatacttttttcacattcctttatgggcaacatgctagggtgcatctcagcagaagggtggccaagcctgggaggggatgaagacagagctggcactaagcagggacatggggaaacaagggctgatcttagccattatttgattatttgataatccaagattcactccaaagaggagcacagcatagtctggttcagcacctgggtttttaagactaataacactgagtcagagattcacaaggttgtggggggaatctttggacctaggtagtagagataaaatgacgggaatcatctatactggccaacattgttctagaaattgtctgaataaagcataacagaatagagaagggtccaaccctctggggatatagcattgacaaggaaaaaatgacctcagatgactggctgcaatttagggcaggattctactgctcccctccccctcatttctgccaacccagcattagctaagaaatccagggatccaggatgtacaagtaatgagggcggaaggagcacataggtggtccaactgtgctgctgaggtcttcccagcactgtttgggatctgttccagagaagggaaggactgtgcagatagctggtggctactgctttgtctgcctagagtggagtagcactctgttctcaggaatactgctttccacagtgtggtttaatgggatcccccagtttctgactgatctgcttccctaactcagtgattggctacagataggcatgttccccaaattcagtcctgagacttctgaccttcaaccagatggaagatcttgggtttgctcaggtggcaaacctgtgaggtatgagtctg

SEQ ID NO: 11180 - DNA, 2816 bp, Homo sapiens
[321 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaagtagagtatcatttaaatttttgtgtttcagtgatgagtctgtaggcatgagtgcttgataagatgcccttgattttagggtgggaatgcagtgaaatggacgtgtgtgtgtgtgtgtgtgtgtgtgtgtgtgtgtgtgtgtgtgtgtgtgtgtgtgtttggggaggggagggggaatgcctgtgcagccgggcacatgatccagtaaggattgttttcatagaatagaaacaattagctggggatgtggtggtggcagtggtgttggaggtggtagcaggagtggtagtggcagtggtggttgtggttgtggcagcagtggcgtgtgcctgttgcgccagctatattcgggaggctgaggtgggaagattgcttgagcccaggagtttgaagctgcagtgagctgtgattgagccactgcactgtagcctagcattggggcgagatcatatctctttaaaaaaaaaagaacagaaacaatgttgaaacatgaatcttattttagtaaaacgagttttttgaggggaggataatatatat

SEQ ID NO: 11181 - DNA, 1189 bp, Homo sapiens
tctaattaatttttattattttggagaaagctttttatgaattgtgaggactgtgactactgtcaagatgtgtatgcctataaacttgttactatatattaaagtcttttgctcacataaatttgtaagaatacctctttgccctaagcaaaatgcaaaagtaatggaattggaactctgctgaaacaggtgtttttagctcatactttgagacgagcctgactagatagcacatactgtgattttacaggatagagaattgtacgctggacatgtaactttcaagttggcttttcccttgggcttagaatcaattactgtagtgtttgaaatgaaggatgtataattatctggaggtttaaccaaggttctttgcatattagaaagtacttagtaggaccaaccctgtttccccctttggtttgtttagaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcggtcagtatatcattcacttatgtgcaagtaaaactcgttcacttacaaccgcacagcattttgagtggtttgcacacacagttttctgggtcatacggtgatacctcgattaacagatcctctgggaacctagctcgtttgtagagtccatctgtttgaatcctcttaatgtaatattggccctgctggtccgcacaaagtggagggtcatggggcctgtccttttaggcacactcttgcatgtgtgcaggtgtggctttgactgtcagctttgactgtaccctttgtagcagacttttgttatcatactctttgcattttaacccctgcaagaaaactatacattccgcacctcttaatatttccccttctctaatgaaaacagaaatagtgcgatggtcttttacttttatttggtccacattgaaagatggggtgtatgttccagccttgcactccaaataaccttctcctcctccccactcctcctcctccccactcctcctcctccccactcctcctcctccccactcctcctcctccccactcctcctcctccccactcctcctcctcccc

SEQ ID NO: 11182 - DNA, 1205 bp, Homo sapiens
agaccatttgagttttatttttcttcttcatgatcttttctcttaaacatataaaaataggctgggcatggtggtttacacctataatcccagcattttgggaagctgaggtgggcgaatcacttgaggctaggagtttgagaccagcttggccaacatggcgaaaccccatctctactaaaaatacaaaaagtaattgggcatggtggtacacacctgtaatcccagctacttgggaggctgaggcacgagaattgcttgaacctgggaggtggaggttgcaatgagccgggatcacaccactgcactccagcctgggcgacagagcgagacgttgtctcaaaaaaaaaaaaaaaaaaaaaaaaaaaaacccataaacaattaagttgatttataataggaaaaaaactaaaatatacttccgaagggccattaaaaacctaaaagggctatgaaagtgtgttcatctcacccagtttttgcagttacacgtgtgttatggtcttgtgctaatgaccgtgtgtttatttttctaacagatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaagtaagtcataccgactttcaagttttactccactgctttattagcaatttagaagcaaggtagtagtcgttctattgaataacatttaccaagatctgaaaaattatgcagctatgccaattttgatgctttatgaaatacagctcatagctcatccaaatctttctgttctttccaggtaaagaccttgtccaaaaacgttacctattatttatgctcttgtcacgaatttttgctcaacaagtaaatatttatatttttttcttaagatgaatttttttttttttttgagacaagagtctcgctctgtcgcccaggctagagtgcagtggtgcgatcttggctcactgcaacctccgtctcctgggttcaagcgattctcctgcttcagcctcctgagtagctgggactacaggtgcatgccaccactcctggctaattttttgtattgttaatagagatggggtttcaaggtgttagccaggatgg

SEQ ID NO: 11183 - DNA, 1262 bp, Homo sapiens
tactgtatatttgtttactggtgtagggcttcctgtgttaagaacaggtatagaaatattgacattcaaatgtaaaattgctactgactctaaatgaaaactttggagttgagtaggcctatttagtttattaatcagattaacattcttttccaagttagggtatcatcattgccttgtctgatcttaaaaaaaaaaatctttaaaaaaaaaggatgcttttgctctgtgttaaagtaacatgaagactttgtacaaacatgtgccagttatagatttgtgaatagtaaaatggtcattaatttagatttctaagtaaatgtagctgaatgcatctttactgaaaatgttaaggttgatctatggttgagtaatgccagttgtcttcaaaagtttgtttcagagctaatcgttgttctatttattgtgtttgtgtgttctcaatgtgcctctgcctcccaagttcttcagctataaagtagcagatcctttgacttaaagaggctgactgacatgatctcgctgcactcttctattttagaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaaggtgtgtgtgcatctatcctctactttaaatgaattgcagatccattcattggtcataaatcaaggctgagctgcaggtgactctaaagcatgcctcactgtcgagggaagggatggatgctggtcgttgtcagtgagcaacttacatgctgtcatcatgtgttcacttgactgtggtgcttttcattcaggagtcctgatctgcctactaaagattagtgaaaaggaaccaatgtctgccctgattttaaaagagtaaaaaagtactaagttttttgttttttgttttttttaatatgtgaaaatgatgactgtgaagttttcctttcctttccttttttttttttttttctttttgagacagagtctccctctgtctcccaggctagaatgcagtggcacgatctcagctcactgcaacctccgcctcccaggttcaagtgattctcctgcctcagcctcccgagtagctgggattacaggcgtgtaccaccacacccggctaatttttatatttttagtttcaccatgttggccaggctgatcttgaactcctgac

SEQ ID NO: 11184 - DNA, 1212 bp, Homo sapiens
agagaaaaaggcttgctatttactaacgtattgatcttagatgtttgctcaagtcagtttgttctagttgaattcctaataatgtattagcctatttaaacatttccaggctgatgggaaaggagagagttgttccgaaatggtttgttgtagagaggcctccctctgggatgttacaggaagataaagtaccaggattaatttgtgttcaatacagaggtctttctttaaagaattttaaaatggtacaaatatataggcctttaaaaagcatttggaaagagaaatgcataacgtatagcagacttttatctcttttgaaatgtatatttagcttaggtttttttctttatatattaaatatttctgaatgaatataaactggtgttgaaatgtgtaccacatgttaagatagcatacttgtgctttcttttagtgttgtgatttgtgatagatatttcttttctttttataatgtagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaaggtcagtaaagaatgaaagctgctctgggtgagtgcaagagagggcactggactggcaagcttccaagatgtgggctcttggcttggctctatcagtaattagtgctgtgaccttaaaaatcacttggtgtctctctgcctcacttctttatctgtgaaatagaccttttcaaatccttcagtcttcagttttcctggtcattgccttcacatgcactcctccagactggtgtgcatgaatgtggtaagttacctatcacattcatatttatagcttaggaaagagaaaaatagtaaaccaaggttaaagacatttgaatttacctctatccttgtgccagctaaggaagaaaggagcagagaaagacagtggaaatgttgaacattgccagtagcatttgtgtgacttacatgattcttccttgagtttggtagtgggaagaggaaccac

SEQ ID NO: 11185 - DNA, 3578 bp, Homo sapiens
tctttccaaagttaagcgtatagaacttctttaagtgtttgtttctttttttcattaggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaatttgctttttccttcattgatcttggataataagttgccatttgtttttcagacacaacctgtattgtgatagcatttcatttatcacatgctttaggctctgcccgaggtggcctgctgcatgcagaggcagtacatggaagcatgccacgagaacatagaaatggtcatggataactgtttacccttgctggtaatgaaaaatacaaacta

SEQ ID NO: 11186 - DNA, 1187 bp, Homo sapiens
aagcccattttggactgcagggccctggggttttctctcttactgtttcccatcatctaggagcccttctggtgctcagtcagctcctggctgggcaagctgcctcaaactctctccttattttggtgcttcccatttcttctctgatgaatcctagcattctctcctaggcaatctatttgaaatgcaagtatctacttactactctggtttttctccgtggaggaggtacatactacttgcatctggttagccattttgatccctcctgagattatccaagaaaaattgtttttaaataaaaaaatttaaacccagtttataataagtgttcaatcacctgaaatggcagaaaacaaataatttaatcattattgaattaattatttgcatattttctgtttgggagattgtaccactgtgatggtgatgtcctaattttgctgaatgttggcactttggtcacttacgttatttcaaaaactacatatgtgtaggtgactctgatcatttttatttatttccttttcagcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcaggtgggcttgcagaatatgcagatgtgccccatttaccctttgctggaagggaagtaaagaagaagggcaactgtactatgtgctcatagaatgtggattattcagcttgctcgtcattgtttcttcctccagattactcaacaagaactggatactgttgtgaaaactcagcatgagattctgagacaagtaaatgaaatgaagtaagtatggaaaagtagcgtttgtgtgttatgtgattttttttatcctaaatttgtgacttcaggtgtgcaagcactgtattgcaagatttctgcatgagggtaagaatcccgttctagattcattttacaaataggggaccataaatacagcaacttttaatattcaaaaactgcaaacatgtctaaagtttttaattgtttagagctggaaaagaaaaaatgttttggcatcttttaaagagatttgtcagttac

SEQ ID NO: 11187 - DNA, 1376 bp, Homo sapiens
cacattgtagttttaaatattttcaaatacatggattgttcctgacaacccagagaagaagggagggaagatcctattttccatatttttagaagaacttgccaaattttaggtgaaagaaatttctgaagatcgtatggccaattgatggtaagccccaggcaggactcggcctggatttctgactccaggttcagtgccctgttacccaacacagtttcttaagttacttagtctacactacagtattatagttttctttttaatctgtctacatctctagattccgtaaaaacagtacaaagcataaagattgctgtacgattgatattaattgctcttgattggtggatgtgactagccaggattggtattttagttaagggttaggaagtttgatttgctgagctggtgcttttagcataaacagcttgaatttgattttttgatatgattttaggtaagataaaattattaatatcttccatgtgagagaaacaaataagaaagtaagacaaaaggtggtatgcactcttaagaaaggttcagagacatataggtacccggcagtatgtggagaccaggattttctctcatttgtctgggacgttgtccatgaaggagatttgtgggaaaccatggaggatcttggtaccagaataaggagtttggacttcttttgacccttcatttgtttgttcatttcttatcaaacattgattaaacatctattatatgttaaacactgctaaatattctgatttagggttttaaaaagtgagttttggattatttctaatataaatctttcaggtgaattttggtctctaagctcacagagtgccattgcctttaccaaattagtgctaatttttgtcaattccctcactggttattgttatttaaaacaataaatattgataaaatacatttacaatgataaaagtaatctcctatggaactttttcagacttttttttttttaatttgtagatgaccatgatgtcctttcttttctgactttccagttgactgaacctggaaaagagccggtaattttacacatattttcaaaaactttatcagtttagtttgccttttagctgaacgttttggaagactaacttaggtttggatcttgtttctgccagttactgctatatggtcttgtgcaagtcactgaacctctgtaatgcttcatttcttttttttttttttttttttttttttttttttttttttttgagacggagtctcgctctgtctcccaggctggagtgcagtggcgcgatatctgctctctgcaagctccgcctcccgggttcacacctgtagttccagctactcgggaggctgaggctggagaatcacttgaa

SEQ ID NO: 11188 - DNA, 1252 bp, Homo sapiens
gttagggaaaaagtatttctatttaaggtatttattttttcattctacctatgccatagatttctgaatcaagacttaggacatttgctgattaacaatgtttaaattaggaattgttataagaattaaaataggcagaacaagttgtgaaaatattgaaccaaaaaaaggccatgctatcatcttagagggcccatgaataaaccttagagggaatcctaaggctttaggaaaccgctgcagcttgtctgtcattttccaatatgttaattattatacttagtgtacagtatttagaatacaaaatgcttttttattttttaggaaaataatgttataaatgattgtatattttcatagtaatgtctttataattatttattaatgatagagctgaattagaaaagctcttcatccattataatatggtttctcatgaaaaacttattacaaatttcagccaactcagatattaagaacatcagtgtcaatcctcctcccctcctgcgacctttttacacttgttttggtggactaggggctccttttctcctcctttttgacatataactgtgccattaaaaacatgatttctgatgaagctggcctagagggaatgaaggagattgcgtgggtatggtctctaggacaggcgtagctgttgcagggccaccctgtccttgggagaacctggtgagctcccatattcacactagatgccatcatgtcagggggctgaagagaatggagctaatcaactctgtcatttggagaagacccccttcagaccagttctgagaactccttcttttaagagaccagagataacttgatcatttctcaccttttcgtagttgttcttttttatgttgacattccccttactgtttttaaaatgcttcaaagcattaatgattgttatgctgtgtgctttcagtactatggcaatatctttgtagcattttcccatttctgtataagcatggttttttgtttttttttttttcgtttttgttttgagacagggtctcactcttgttcaggctagaatgcagtggcaccatctcagctcactgcaacctctgcctcctgggctcaagtgatcctgccacctcagcctcctgagtagctgagactacaggcacatgcccccacacctagctaattttaaaatattttttgatggagacagggtttcactatgttttccaggcagcagcatttttttttgactgggatttctttatgatgc

SEQ ID NO: 11189 - DNA, 1386 bp, Homo sapiens
ctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggac

SEQ ID NO: 11190 - DNA, 1122 bp, Homo sapiens
tgaattcttagagaagttacaagtgtgatttctgaatatgctaaaagattgtggttgtataaggaaggtgacatcttttttggagaatcttagttgtttgtttctatgttttttgagacggagtctcgctctgtcaccaggctagagtgcagtggtgcgatctcagctcactgcaacctctgcctcctgcgttcaagcaattctcctgcctcagcctcctgagtagctgggactacaggtgcgcatcaccatgcccagctaatttttgtgtttttagtagagacagggtttcaccatgttggccaggatggtctcgatctcttgacctcgtgatctgcccaccttatcctctcaaagtgctgggattacaggcgtgagccactgcgcctagccgagaatcttagttgtaacctatgtaaccaaacaaagtaattccatatgttctgcaaatattattatcattaatattccttataaatatcgtgtttttcagttcactagtaagggactgtggctctcaattttaacactgtttttttttttttcttctagtgcaaacccagcctaccatgagttactattaactgttttgtggtatggtgttgtccatacttcagcactcgtgaggtgtactgctgctagaatgtttgaggtatgtcaacacatgcctctgttggtttcaattataatgatttttttttttttgcgaagaagaagggaattttttttaataaaaaggctttgcatatcatgttatgttgatatatattttatggctttgaacagtgtctggttgtgtactgtgtgatggggcagaaatttagctttaacatatttaaaaatgttttctcagcttactggttccttgaatgttattcaattatcacttttatttctcaaactatcttttaaatcttattttaatttctaacttatataactctttctgactatactttttgatttactgaggtaaataaactgaaacaacataggatatctttcaagttgtaaaatatagttgaatttatcagtagcattagaaaatcaattattgaaattatggaaatgtttattttattggttactcctacgtcactattccctaacatttcatatgta

SEQ ID NO: 11191 - DNA, 1792 bp, Homo sapiens
attatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacactttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgatttggtttgggctatgcattttactttcgttttgaaacactatactttctattaagcaaaaaaatgagaaaagcctatattcatgagaatatactaatattttgtaaatataatttatataaatttacctattttggtttatttttactaaaaggggaccatgttgctataaaactaatacatttcagaggtacctggaagaaaaatgtttaaactctgatttgcttcaaactatagtagaatatgtgtatgtttgttatcaggtgaatgggtagaatgtatttttattgtgaacatttttcttaattaatgaatatatttatttaagtgctaatgtttttttaaaggcaatagtaggcaagattcacagtgtatttcaagtgagagtctcttttcttaaatattttaatatcattaagatttcacattgtggttttgttttttgtttgtttgtttgtttttagtaaaatatgtcttgtctttacagacaagacagacactaatcattgagactgagatttggactgagtcca

SEQ ID NO: 11192 - DNA, 1225 bp, Homo sapiens
tcgctcgcttgctcccacccgcacccgggctcccagaaccggcgaggagcccagggggaggagccgtcgcgggcacgccccgcccccagcccgggaagacgacgccagcgaccccgccggccggccaccgcccccctcgccggccgagacccgcccccggccccggccctcccccggcggcatggaggggccccgctcctgacggccgcgccgccgcctcggcccgtgctccacctcgcggcccctcccgcccgcccccgctcgcatgtctgcgccgccctagccgaggatgctgaggatgaagctgccgctgaagccaacgcaccccgcggagccgccgcccgaggcggaggagcccgaggcggacgcgcggccgggcgcgaaggcgccttcgcgccgccgccgcgactgccgccccccgccgccgccgccgccgcccgcgggcccgtcgcggggccctctgccgccgccgccgccgccccggggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcc

SEQ ID NO: 11193 - DNA, 1221 bp, Homo sapiens
gtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcatagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagcttaagaattgtgcctcattgtaaattttgtaaaagtggagatagg

SEQ ID NO: 11194 - DNA, 1388 bp, Homo sapiens
tccagcctgagaataagctcattgagggcagggactgtgtctctcaccacagtgttcacagcacctagtatagggtctcgctttcatgctcagaacataaattgcaaaccaaaaaagccttgattgtagtttggctatttgagatgctgcagtgggtctttttaaagctattataaccctaagactgcaagcaatatatattttattctgcttatggtttgaatttattaattggacaaatattttgttatgtatctgggctgtccagcggtgcagagcacacacattctgttctcacagcttactgacatttacagagttttcattatattcatccttagagcagactagaagatttgtcttagaaactgtttgttagagacctaggtaccttgaaatagtcttgtaccgttggatgcactaaaagctctctctttatcttgcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctgtctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaa

SEQ ID NO: 11195 - DNA, 1226 bp, Homo sapiens
tagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataacctattgactgtattctgtgtattattctttattttgggaccttctgtgtaaaagaaaatattacctaaattggttagatacaaagaaatcattaaaattattaatgtatatatgaaaattctgtt

SEQ ID NO: 11196 - DNA, 1144 bp, Homo sapiens
atagaaagcatcaagaaaaaaactaaaagcagctgggtgcagtcgctcacacctgtaatcccagcactttgggaggccgaggctggcggatcacaaggtcaggagatcaagaccatcttggccaacatggtgaaaccccgtctctcctaaaaataaaaaaaaattagctgggtgtggtggcacatgcctgtaatcctagctactcgggaggctgagggatgagaatcccttgaacccaggaggtggaggttgcagtgagctgacatcgtgccacttcactccagcctggtgacagagcaagacgccctttcaaaaaaaaaactaaaagcaaccaaaatctatcccattacccaggggataactactttttgttgtatattcttaattttttttccaaaagtaaacattctaataaaacatacaaaactattatacattttaactttcctggtaatggattaagtcttaatgttcaattttgtttcaaatacatatttcagattactgtttatttcaggttcgcggaccttcccgagctgatcctaaccatcttgtagatgatctgctaacaccttgctctccaggtgaccctggtgccattgaaatgacatggatggatgtccctggagataaacttttggagccagttgtttccatggtttgaaattttgtttgtttttaagaaaatattttaaaacattatacttcataattttcagttatataagatttgctggaaaatcttagtataaacaggtgtattttacttaatattgttgactcattaaaaattatgaagttaattgaacttaaaatataaaaagtcattatttttaaactattttcttgggtttagaggaacctttaagtgaaaaagctattttttaaagcacaagattctgactttacaggtcttatagctagaatatctccaaaatgctcatatatagtataattattgtaaagacctaactaaaaaatagggttggtgaaatattttttttcccctgcatctcagattttttaaaataaccagaagtcacctgtaatcccagcactttgggaggccaaggcgggcagaccacttgaggccaggagtttgaaactggcctggccaacatggtgaaatgccatctctcctaaa

SEQ ID NO: 11197 - DNA, 1192 bp, Homo sapiens
tttgtgttaaatagatttaagtaaaggaggtaaatgctaaattcatagtgttttttacctgtatcacttccctgtgtattatggaaaaattagagattttaacgttattcaaagttttactggaagcaaaactgtgccagggacagagatatacaatttaagttttctctttttggcaactgcacttgcttaaaatgtactgaatgtcagctggatttcacagcatatcagatttacagtctttgtcttatcaaggcctttactgtatgttttatactaaccagatgggaaacacattgagcatcatatctgacatgtatgcctaagggaggagctcccccatggatcatggcgttaatgtttacaggacatttactattcttagcattattgatgtttgctttctctacttttgaggaatctgtgagcaattattccgaatgggcagttttcacagatgatatagatcagtttaaaacacagaaagtgcaagatttcagacccaaccaaaagctgaagaaaagtatgcttcatccaagtttatattttgatgctggagaaatccaagcaatgagacaaaagtctcgtgcaagccatttgcatctttttagagctatcagaagtgcagtgacagttatgctgtccaacccaacatactacctacctccaccaaagcatgctgattttgctgccaagtggaatgaaatttatggtaacaatctgcctcctttagcattgtactgtttgttatgcccagaagacaaagttgcctttgaatttgtcttggaatatatggacaggatggttggctacaaagactggctagtagagaatgcaccaggagatgaggttccaattggccattccttaacaggttttgccactgcctttgactttttatataacttattagataatcatcgaagacaaaaatacctggaaaaaatatgggttattactgaggaaatgtacgagtattccaaggtccgctcatggggcaaacagcttctccataaccaccaagccactaatatgatagcattactcacaggggccttggtgactggagtagataaaggatctaaagcaaatatatggaaacaggctgtagtggatgtcatggaaaagacaatgtttctattgaatcatattgttgatggttctttggatgaaggtgtggcctatggaagct

SEQ ID NO: 11198 - DNA, 1120 bp, Homo sapiens
caccatgttcaccaggctggtcttgaactcctgaccccaggtgatccacccaccttggcctcccaaagtgctgggattacaggcgtgagccaccgcacccggcctgttttactttattttgttttttactttctaaatatgaacagtgttcttgctattttagccagtatttttgctattttattaggaaaataaccaccaagtttcctgttactcatgggctgtattatattttattctgcttttaattaggtttccttagatattttcttcacagctctttgcttctcacttttctctgacaagatattttcctgtttgaaggtaacccaggatacaatttgaaattctttgagatatctttttataaacattttctttgcttataaagatcctttctcttgaattgtattcgagttacctttaaacttcaaattctgatttcttaatctttaataaaaagtatactaatcttctgaaggattttctttttctgatcgtcacagcattgcagatgctaccctcatacagacatgtgtccaggaactcagagccctgctgccttcatcacctccagctgaacacactcaggctcaggtaagcatctcaagtctgtttgtgggtttgtttacgttaggtgtcaaaaataaaaatcttgctgaggagatactagtcataggaaaaggatgaaaacctctcaaaatatacatggtatgatgagattattcgaaatacgttacttgaaattttaatatgggacatgtctggatgttagaaaagagaggtggggtttgaagacctagattctattcttgactccatcattaaccagctttaaatgtatgatcaagtgtctggatatcttggagcaccactttaataataaagagggacattggtatagttcacttcctgcttctgtgattttaggctatctctgttatttacaccaaagttaaagttgttaaaatatttggtggctaagttatgtgtattttcaaaacccaatttgataaaaatgatttattcttgttccttcacagatatttagttttaaattcttgcctatagctagaatctatttataaaacatgcttaacaattattcatgtagctgttg

SEQ ID NO: 11199 - DNA, 1218 bp, Homo sapiens
gatttgagcattgcacatagtatgcctgtatcaaaatatcatgtgtaccccataaatatgtacaatgattatatatccataattaaaaatttaaaaataataaaaatagtaagattttactctgaagaaaacctaaagattatttgaatttggacacacctttggcccctcgagtttcagaaaaaggattgtaaatcatctttttgttctcagtgtctgaatacgtggggcatgaagtcatgttctgccctttctgacctgtctcttctgcatacgacaatgtccgtgtgtacacatctacacatctacatccacacatggtggaaggtggaggtcaggagtagtaggggtagcctgacccctaacctcaaggttaagatgagccaagaagctaaggcaattccccaactatacattatcattttcaggaactttcctatgattataagaacttttgagtattgtacatagctgtaaggtaaataataattcttatgtttattttcaataataggtcaccaggaaagtacatcaccacggccacctcatgattcatctctttctgctcccctgcccaaactgtgtgtttttgttactccatctcttctttcagcaatgtgcagcctcttggacaacctcttgacgattgctcccagagacactgcaaaggcttttcgacaagctcatctcatagaacttctctgtaggtaagagataaatactcctagagaggcatgttagttgagataaatttacacaaactgtattcatgacttgatacaagatttcttgtgacctggaaatacagctttattcttttttaggctcattgaactctaggattttgcttttgccagaattgtcttggtggtttttattttacatctattaaagcacttgtattagtttgttatcttgactattaaggccaaagaaaaactcctgctttctaaaattcatggattctaaaccttatttatcctccagcacacttaaggaatatggtgctatcccctgttcttaatggatgtgagggactttgggaattcatctttttagtggtcatatcagaataatgtccctgggttgaaaaattattggttaaattcatttggagttattttgttaagggaaattaaacttttcatcaaaaagtattctgataaaatttagggaaattaaattcaaagaaaaattatttgaatttttattacttat

SEQ ID NO: 11200 - DNA, 1191 bp, Homo sapiens
aagttttactttttccttaggtccagtagctttttcccttggtatcatctgattctgctttttaacagttataatttttactttcttttaaatattacatgtgtttattacttttaacaatctatcatatgggaaaactttaaatgaaaaagcattttactctgtactgttttagaggttaaagtctgatttgttcgtagatatgaatcactaggaaaagggtcctggattagaacaaaatctcagtaagtatatgcatgagtgttatcattagtgtgatggtgattacttttgaatatcttaatattctaatctgtctgtcttaagtgaataaaaatttttataaggaggaaaagtcaatataaacatttgggatgccaatgtaaaatcctaatattgacagatatgtatcagtttttcttctggctgtaagtcaaccttttgttaaaagaaaatgaagataaaacagcttttgggagagtttataatagaaataagtgtgagcttttatttaaatagctttatgttcctccttcattttttttctttttgtctagaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtcagtgtaaggtcaaggctgccagtttcaaagacctggattgcattgtattgtgttcatctcctaacctttgaagataagagtctatgcccttactgctgctatcatagaaagaaaaactccaggatttttatcatctgtaataatagccaaagagaaatttttaatttagttattgcattgttgaagggattattaataaacttgtaacaatttattcttagaaaattttacctcacaaaagcaaataattaggataagacatggatgaaacaaattgaatgtttatttctatccatgttataaatgagttgagacatcagtgaattgattaatagctgtgatacacctgccacaggctgttttgttttgcttttgttttgttcttaagtaa

SEQ ID NO: 11201 - DNA, 1266 bp, Homo sapiens
aatattaaacccttcgtttttgggaaaaccagatctatttttttctttaaataaaagtagtgttttcagttagtgctctcatgaagccacatctgtgtcactgagttcaattaacttagtcgatgaaatgcctgctgatctgtagtgggtggtaacataattattttaatttggactattttaaaagcatcaagagatcgcatctttgggaacccacaataaatggttacttttggcaatcagattattgttttataatacaagtaatcttttcattttgtaagatttttatattgtttgcttaatagggatatattattaaattgaataattattgctttccaagattcccttcagcgctaatgatcaatgaatgaagtttatgttggctcttaatgtacatttaataacaaatttcatgtggattactttttgttccccaaatctgctatttaaaactccattcttcatttggatgtactttagaaatggggaaaagattattttaactgaaaactcaaattctctactgcaaattgaatgacaaaatcttgtatgttctatgtgaaagcatttgaataatgggcaaattgctctttaaattagagcttttgtgttgatctgaaggctctgagagcagtcataacagttgtgttatttttcagttagttttacatgcatgttgcctttcacaagttagatatttttgctttagtagttcattacatttaagatattttaatatataaacaaattacttttaatcttaaagcaatgaagaaactattaaaacactttgctacagtacagaataaaaacaaaacatctttgttcataatttgtcaaattctgaaagaatcttacctacttggtagtttataattcatgaggtcattctttttcatagacaattaatgtggtgagatttttagggaatttgctatatttttagttaaaataattttgtttacattaaaatgttaaataattgttttttaatttgtcattgtcagctataatcatatataggtgaatggtattaaaagaactatatataagatagtattttacatttatcattctggaggtcaggatgtattatatatatatcagaaagtattacaatagctgtttctaagccaccaactgtaattataccttagccaataaggttgcagatgtggacatcattaaggatcttactagtagtaagttggggtgctgtcttttcagtgtgcaaatgatttccattatcaatgttgccca

SEQ ID NO: 11202 - DNA, 1174 bp, Homo sapiens
catattgtctatcatatatactgccatttaaaaataggtttttaaaatttagctaagtcttaagtaatttgccgttgctaataattttatctccttgagtcggttgttggggagagatgttatattcaataatttttagttattttgtaatgcagagtgtttattcatttcacagttctgcaatggatgtagtattttgggattgccctgtccagaaaattttcagctacacacctttaaaggaaaatgtttctatctcagatgaaacatgtaatttgggatggttcttcctttgtcacttaaaggaagagataggaaaagtctcttacccactttaaacatgagggtaaaggtttaggtcaaacttactggctttgtcattcaagcatatctgaatcctcacttttttctctttgctttttagggtcagaactgagatattaccaagaaaaggcacaatgccataatattatggtgttatggtattttgacttaaaggggaaaaggtacttaattttggtgggatgttgattgtaccttgttaaaaagactctcattttctcatatgttttctcctaataagatggaatatggagtatactgtaataatataagtgttcattataagctatttggattaagaactattgcagagttgtaagcttgttatcaaattaatgcaagacatttaaactatttttttgcaaaactatttatttttaaaacaacttaaagtatatctagggtgagttaaaagtccctgtgcatctatattagatggcaggttttgtcacagagtcactgtgtattaataataaatgttgaaatggcttctccgtgtctccagaagcatttacatgtcctccttgtgagatcatggtgcacagaggtctttggactgccctgaacccgtcttatgtggacataacctattcccttcgttttctcatcatgccatgtgtttaagatctacccgcttagtgtcaagattattgagattttcatctaaatgtttttaaaattgtattttgtgttttagtggaggacagtcttgatactgttctaattcagaaagccaaattttgatgcgcttttgtatattcataatatatactttaatatgccctattctaatctagtttgaaattgttagattctgatagtataatgataa

SEQ ID NO: 11203 - DNA, 1228 bp, Homo sapiens
ggtcggcctggtggtggcagtgaagacccaggaacacaggcacactgcttctcagggtgatgcggtgcctcacgctcggaagcgctgactggttgttggtgtgatttgtgtcacatctgtagccactgtactttaacttccatgaggagagggacaatatttgtgacacatttctctgagctcccagtgctaagtcctaaactgagccctgtgagagctcctgtgtatatttgagaatgaatattaagtgatgagacacacaaaagcccaagtataatctaggttatgaagtaggccatgaaaaaccaatgatagtattctggattttgatgccacacgcagcatttctagtgagttttacagagtcacgattttctgtgaaaatcaggtctgattggcctttttatccttgtcaatctgtgtttattttgcagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcagagtgctgtgcaatgcctttcatctcacattagaaattatgatttatgggtcatttttaagttaatgtttgaaggattcagttatattttaaaaacaaaaataacagtgaaacttcatataaaaagaagaaaaggtatttacttctcttccgcccttcgttaaaaatctaagaacttttacttaagcaaatgatcatgtgatcactctgtgtgtgtgtgtgtatgtgtgtgtaggggtgtgttcttacagataacggtttttctttttctttattggtaagaagctcaaatgagaaaatgtacttaaatattaatataaatttcattatattcactagaattagaaagtgctacattcttgacagtcagcagccatatcggtatttaataaagttaaatagaccagtggcctcattcacaaggaaagatatat

SEQ ID NO: 11204 - DNA, 1111 bp, Homo sapiens
catggggttcctagaaccaatttcttgcggagacagagggataactagtaagtagcctaaagttttaatgaaaagcagaagtaacctacttatctgctatagtacaataagaatgttcaaggtctcttttctgggcagaacctttgtcttatttatatattgccagtacctggaaaatcatggatgttcagtgggtgttaggtgaggagaaaaagtctaaagagagtactattgttgaagtgaaaattatactgggcacattctgagaattttgactttggcttttaaggaactagatgctttagagaagatacatgaaattgcctttagcattttttttttttcaatgaggcaaacattgttagtttttttttctttctccagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacataggtaagtaccaatcagcagaactgttgagtgagagcatcttatatgtaaatattagttggcattacttttgtaattaaaaaataagagcagcgttttttaattttatcacatattaaatgtacattctgcattaatgcagaagaggaaaagagtgcattttatcacatttctgattaggtctaaatttaacttcctcgtatcttggggttgtctttaatggtaaagaatgatgttctagttaacaaaatttcctggatgattgatggctaacctttgaggtttttcattttaaccatcttaacagaaagatatatgttatcttccttctttagtaaatggtatactaatcatagtctaaatatgaggaaaccaagtcataattatgagttattttgtctgccttctgttgaacttactagatatgtgatcttgtgcaagtaacttactctttctgtgtctccattctctcctctatgaaatggaatgatcgttatactggcatagtatttagcatata

SEQ ID NO: 11205 - DNA, 1139 bp, Homo sapiens
actgccaccacgcccagctactttttgtattttttggtagaaggtttttactatgttggccaggctggtctcaaacttctgacctcaagtgatccgtctgccttggcctcccaaagtgctgggattacaggcgtgagccactgagcccagccaagtggggcatgagttttctcataaagccagcagggcagagtgattcctagtatagcagggcatgtgttacactcatgtcacttttagcaaatccacgttgccttttcagcaaaattcattacagagttaagaaaaacatgccctggtaattttctgttagaaggagcaaagattttgagtccaccacagtgcacatcatgtcagcatcattgctttttgtgtctttctagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaccgtgtttgcctgtttggtgtataattgtctttaatgtttagaatctggttatttagaggattccttcaatgtgttactcatccagacccacagaggccatatgactggaggtgcgggaaataggtttgagtgtctcctttcacatcgtcacatctcattgagtaaccatgtattgtatgcttccgatatagtttctttttttcaaggaaattaagaaaggccagaaattatagtttaaggatttctaataattgtcctacttgaaatagatcttaaaaagaaagtagcggctgggcatcgtggctcacacctgtaagcccagcactttgggaggctgaggtgggtggatcacttgaggtcaggagttcaagaccagcctga

SEQ ID NO: 11206 - DNA, 1373 bp, Homo sapiens
attaaaataagagttgtgacatacagggattgagaaggacttggagcactttaggggagacctgtcgggggaccatctgcccagcatgaatgagccagtcccatgaaacctggggttttggctgcagctctctgctctctgctgtggtgcccttgaggtgggagttgagactcaacatgtagggcagggcttagacactggaccaagttgaggactagctaaaactggaatggggttgaagcagctttccataagacataaccaccagtgtgccatgtcagtttaccattgccacggcaatacccgggagttactgcctttttctatggcaatgacctgacaaccccaaagttactgccttttacctggaaatttctccataaaccacctcttagtccacatgtaattaaaagtaggtataaatatgactgagcagtgacgtgacatgcagcccgcggtctgtacggacgcgccctcgcttcttcctctttctcgactccatcttcgcagtagtggcagctgggaccgcggttcagtcaccaatatgcagctctttgtccgcgcccaggagctacacacccttgaggtgactggccaggaaatggtcgcccagatcaaggctcatgtagcctcactggagggcattgccccggaagatcaagtcgtgctcctggcaggtgcaccgctggaggatgaggccactctgggccagtgcggcgtggaggccttgactgccctggaagtagcaggccgcatgcttggaggtaaagtccatggttccctggcccgtgctggaaaagtgagaggtcagactcctaaggtggccaaacaggagaagaagaagaagaagaggaagaagaagacaggtcaggctacgcggcggatgcagtacaaccggcgctttgtcaatgtcgtgcccacctttagcaagaagaagggacccaatgccaactcttaagtcctttgtaattctagctttctctaataaaaaaaaagccacttagttcagtcaaaaaaaaataataataaaataaataaataagactgcagaactgccttgaactgctaacctctgtctctgcaggaacagtcacgaagctgtcacactgctgcttcagttaagctgtttcctctggcttgcccttgaattctttcctgggcaaagccaagaacctcacaggataagccccactttggggctcacctactctgcatccccctcacaccaggctggcagtcagttcatggcctgggtttggaatccaggtgattgtaggcagcaggtcctaggacctgacccccagtgctcctcccctggcctcgtggccatgttatctctgactttctcagaatgcaggcagaccacactagga

SEQ ID NO: 11207 - DNA, 1198 bp, Homo sapiens
  misc_feature (1)..(121): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtctgtcctgtggctgcaggtaggatgttgtgggggttgctgtcctctgaaggcttacctcaagctggaggatctgctaccgagacaactcactgccctctggctgtgggcagcagcccccagctcctcactggctctgagtcggaggcctcatttccttcccccatgggcctccccacagctgcttaaatgtccctgctacatggtactggcttgcactggacagagtgaccctaggggagggcatgcaggaagcacagggtctcttagaacttcgtctccagcatgcagcatcctcacttccactattttctgtcccttacaaacagctccgcactcaagaggaggggaattgggctccatcctttaaagggaatgtcaaaagaactcatttaaaccaccgaaggcattttcctgggtagggaaataaacaattttacaaacatgtaaattaggaatgcaaggtagcctggtctcaggactgtgaggacgtgggtttcctggaccccagtgtttatgtgctagtcctcttgtgaggaagacagaccctattacatctacacgtggtgaaattgcctccactgttatctagtgaatggttttttagggtgttgtatactctcttctcgtggatgagtttgtacaacttgcagttgtaaaccttttcatggaagagtgtttttttttccttcataggatcagatacttgattttgtggtctttgttatgaatggatgtttctgctgggaggagactggtgaggagagggtggagtgcagcgccctttagttaccctcagattgtgcacatggggtttcgtgactacaactaatactaagctgcctttatgcatggacttgatggctctattaaatgaggtaataccataagggcaagacacattttcaacaggaagtcagctgacgtgacagatgaagaaagagatgcgagtggccccctagtttctattgcctcttaccttgcgcagccattgcccttgcagctcgcagggggcttgtgggcagccctgcctgtccggccttgccctgcgaggagcagggaatccagttctgc

SEQ ID NO: 11208 - DNA, 1858 bp, Homo sapiens
ttttacagagtaggagctcattgaaatgttttttgaaaggagagcttctctttttgttttttttttaaaagggtagtaaattgaagtatgctggtacagagaattgaaatatgggagtttttctgcaagcttgttgagaaatcactttttctaccaaagataccatagtatttcttctggagtcaacaatagggtgacatggtgttcctaaaatcctacttcatactttttgataaaagactttagacatgtaatcaaattcatctcagtataaagggtgtttcattggggctaacttcatgatactttttcatctagttttagactaatacgtgtgtctttatattcaagatttaataccatgtttgtttacttcacaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatca

SEQ ID NO: 11209 - DNA, 1113 bp, Homo sapiens
ctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtag

SEQ ID NO: 11210 - DNA, 1190 bp, Homo sapiens
aacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgt

SEQ ID NO: 11211 - DNA, 1162 bp, Homo sapiens
tcaggattgcaggcagatacttatggctcctctgcggggtggagagccttctcttcaagcttctctcttggttgggttcctcagctcttaggaagcaatgtcaccggtactcctgcatcagttacatcatcaaatgcgacatcaaatatctggattccatgtatttgtcagataatttactttgatgtcacgattccttctttcttctattcatttcttaatgtcctttcagttttagctttcagttatttccattgctagagaactgcttttcttcattgacttgtttcgttttcttcctttcgtaaattgactccgctcatttagcacacagctatgacaatgacttaaatttaagactgttttaagaagtaacctcataaaagttacatgtttattgtgaaggtagtatttaggatgctgttcatggaaatacatctttcttttaagactcagaagaattatttctctctggtctttattccagagaaagttgtacttgtctctaacacttcgttagcctttgatactagcaaatcatgtatatgattgagttttcctctttatgtttactgttgggaagctcatggccaaaattgtgatccatctctagtcagcaggatagccttaaaggcatgcattttatttactactgttatttccagttttatttattttttccttatggggaagtcccattttatgtccgcaatatattttaaaaacctcccataaatcaaagctcatgtaattcaagggcagttttgcaatagaaattgtttttgagtaaaaccaatatttttctggaagtgcatatatctttagccatttggttttgggggcgttgtattgagcattgtgcatccctgtgattaggcatattttaattgtgcttgctctgttgtaggaaactgctgtgcacttctgtgtagtggtccagtggtgctttttacttctcagacttatttatttaaaaacacgcttgcttctaaagtttgctgaacagacccagttaacaagtactcccaaggaaaggaaagggaaggattcctttccttttataccaggagtccttgctctctagctgtataaaaaatactgtttcttttagtacatcttggttatcttgaaaaaaaaaaaaaaacaccaccacagtttacta

SEQ ID NO: 11212 - DNA, 1114 bp, Homo sapiens
ataacgattgaataattgtgcccaaagggtatcttctttgaattcttaggatgtttgtactgctatatatatttagttatttcattgacttttatattcgtgttatattcaataccctttcatgtttttcatttaaaaaatatttttatttcattatttccttactgtaaatggtaatgattttgtgaatatggatatttaactatgaatctgtaaattaaatcctactcttgaggataaattgaagtttttaattctgaatttatgactttcaagtcacatagagttacagattaattcagtgttttcataggtgcttagtgagaatagaatatctttccatgatttaaagattaatatttcattagatattaattgtgaatagtattttctttgatacccactggataagacttagaactttaggaattttctttaaaagttctctaaaattgtttaaatttgttattaaaatcttcattttggttttatccaatacataattcctttgttaactacaaataatggatggaaacattgttggttattttaagcagtgaggaaacctaggtcctagagcagagtattttatgaccggtaactttacagaacacacgccagagctctcactcaggaaagctggctgcacgttggatcgagtgtggcacacacagttccctgggtctacagatgctgtaagtagccagatatgtctgggagcagccaaatgtttttctgagaattttaacaacagtgataggagagaaataaaaaaaaattaaatcatacatttatgaaaccctgatgttaaccttatagaataaatgtataattgcagttctgctgtttttactataaagctgtagctatctttttgttttgtttgccgaagtaccaagatataaaatgcatttatgtagtactgtatcgaagttatttattactttaatacatgatagtgggtccacataatttgtcaaattttaattggttttgtcacttgtcagagtcaaatctcccaaattgtcaaataaatttattttagaatcatacatcctaaaatttgataattctgaagtttttcttcttcagctttgcttccctttttgccaac

SEQ ID NO: 11213 - DNA, 1184 bp, Homo sapiens
tgtttttccacgctggagatgttggcttcaagcacgcagaaggagctgcagcatcataatggcatcccagagcagcgagccgaactcaaaatcctctccccaaaagcaaatcctcagacaccccagtaactacctttttattccatccaagctgtgaactttcaatgcattcggctctgagaagggagtaaaatatctttgtgctcacgaacgcaaacgggcagaaagtgaggactttgtagatgggcacgaggctgcattttaatgtcactgtgccttctacgcaaagctgcttattgccctgttgaaaacagacccaaaaaagaatgattttaggcacactgtttggttaactactgttactgtattgaaatctgacactgtcttttttaaaggtaccgtaatacaaatactacattgagcatccatgccccattaaggctttgtgcgattttggacacataacagtgactaagcagtgaaggatgcaacctgtaccacgtgcctgtttcccaaacgctgtatccatttggccatttgcatttggtgagctttacagttcatatttactagaaagagctcaaaactggaggtcgatgtacccagtacattcttggtcatagcccagttagggtttaaagttatagaagagattcacattcgtttaaatgacacttgaacttctacatagctcaacattaattcatcatggttgaaatggaagaatcttcagtgggtgaatctttttcaatctgattgaggctgttacattttataggtgctatttttcaaagcagtactgacagcactcgaagttattaaattgctgaatcaaaagatggacccgcgctcgcatttatgaactgtgatggactcgctgggcctgtgcgtgtgcggaggtgaggacattggtgttgctaggcttcgtcacaccccacaccgacagcagtatttacccatttagtttacattaatggtctggaagtggcttaacccacctctggattaaaatacattcagtaagtagttcagaatagcataattatcagtgctgcaagggatccaaaggataattctatacccaagagatttcctgtccagttacaaagtaaagaacaattgcttggactcaagcatgcaccatttcttcctgagactactgaagaagaggatgtttgttcttt

SEQ ID NO: 11214 - DNA, 1168 bp, Homo sapiens
acacacaaaaaaacctcaaaaatgtctttttactattgacctttagtgggttaactcttggagccccataaacccttcccataacacacagcccgcatctctacttgcttgctaatgtcatcagctaaactcttccgcaaaataactaaaacaggaatgaactcatttctttcctccaaagctttctgagagctaccagaagaaatgactcttacgcaatataaaataatgttgtcatccaaaagcataatcttcagacaagtatatagagacaatatatgtaaaaccatgctccttatcttggctaaagtaaactaatccagtaagatagaagatcaaggattttagcttaactttctttttggttgaagtacttgtatttaaatgctaactgacgtctttccttgttgggtctcagtctgttactaaagtaaaactttaggaagtaagtataatatattggacgggggaaggctaacgtgaggcagttccggggtattttctcagcctcaaaggacttccattttgagcttacagaaaaccagaaatgagaccttaggcctcaaggtgaaagttgaatttctatttcctagaggtaaatgatagttggtttgctctttcttttagaccttgaggatattatattccttctccatgtgaacattctggacctttctttatttttctttttaagcattagacttaacacgacttaaatcttagaaaatatgtcaatgcatttcggtgcctgggcacacaattaatcttcatctatctctggtaatataaacacacctgtgggatgttttccattgaatacatgaaaagaaaactcataataaatctcagactgatagctttatcatgactgacagtgctgctggaggctccttctttatgagtataatttgggagtatataaaagcaggagattgatttctacagaaacttgccttttctttagtatttattccaagctgtgtgactcttcctcttttttaataaaaaagccccacaacatgcagttcctatatttaatttatataacggaatgtacacatgcacacactcacactcacacacatgcattattatttaatgcctggaagacacaaaatgctgaatgagaagtgtgtatgtgatttcctcctgcacttctcaggcaaga

SEQ ID NO: 11215 - DNA, 1056 bp, Homo sapiens
ggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatatttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatt

SEQ ID NO: 11216 - DNA, 1164 bp, Homo sapiens
ctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgcccccccgtcctacactccatcaaacaggagccggtggccgaggggcatgagaagcgcctggacatcctcaacatctttaagacgtacattccaaaggactttgcgaccctctaccagggatggggtgtcagcggccctgggttggagcacagaggtaagatgtgcgggccctctcttccccaggccacatgtgacccccagaaccacccccggagggccagggctgctgcgcacctgcctgtccatgtccctgaggacagagccagccggccccatcccactgctgagctgagagctgctcccttgccctggccgaggagcacagcagatgggaacagctctcccaggctccacattctgccctgccggggaatgcctgcctggggttggtggccctctgcacgttggccctgggaggaggtcgcaagccctgcacggcttccttcctgctgagaggacgtttcctccacaccgacattccgcaggagcaggccgacgtgattgcacttcacgtgtttgtcattttaaacagaatccgtagatgttcattgtcctgtctctcaaaagacaagaatattcatttaatgtattaagttttatttttattcatctgtaattaaaaaaacacctaattagtcctctaatattagtaagcaaagctttgcagaggatcgatgtaccata

SEQ ID NO: 11217 - DNA, 1437 bp, Homo sapiens
ggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttcttcctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccaggtgagcaagtgtacccaggtggcctgggtcctgggatcccaggctcaggg

SEQ ID NO: 11218 - DNA, 1181 bp, Homo sapiens
agggtgtcgttctacagccgatacctgaaagttaaacccagtgtaactcaaaagccttaaaatagggattcccaagactatttagagacaaccaaagttgtgtgaggtaagatttctgaaagtcaaataaattttaattccctttaatttagaaatgtaaatgcttatattattttgggtgggagcaagatgtcatatcatcagaaaggacgttacagcctcaaagggttggaagcctcacttataagtgatgacttggaattgtagattcttatttcttggagtggaattagaattctataggtaaagcttttgactgattttggtaggcagagttgggccatcgttaccttctaaccttttagttttgttctgtcttagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggtaattttcctaaactttaaagtttggacatttgggatagcatattgctggtttttaagaaatgtgcccttcttttttcctctgaaggtgataggatatgtttgttgaatgttttgtagctagctgtagttggttggtatttaaaattaaaaagaatgacagccataaaatgcctgaaacttatcacttttctttaacctggcttctttcctgtattcagtttctcctgactcctcgccagggcttgaaagcttcttgtctctgtctgttctcttgaaagcttgttgtctccgactgttctctctctgccctgcttaggcgcctcctctccactcagatccatggctttgcttcagttcttctcacccttggtgcttctggcatccagccatgtgattttagtagcctctgactagtcctttcctcttcatcatcaaaggacccctgcagcacagctccctcctccacacctcaccatttcccattacacaccaagatccatttcttggctcctgagtatcctgtcacctgtcccctgcatttccatccgccctccctctgtgcttctagg

SEQ ID NO: 11219 - DNA, 1494 bp, Homo sapiens
ttgtgaagagcaaagcacttggaatctccgttttaaagcttcaagtgttaaaaatgctacaatagttttttatctataaaattatctaaagaatcattgtctttcagagactcataggaaaaaaaaactaggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacattgaaaaagtatgtcagattttccttcatgtttctggttataagaagcatagcttacaaagcaagcgtaagattgaggcatgaagttcagaaaaaaaagtgttacaacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatattt

SEQ ID NO: 11220 - DNA, 1201 bp, Homo sapiens
ggcaccgaaggcaggctggagaagcgcggggcggaagcaagaagccgcgcggcgaggagggcgcgtggggccccacacagccatggggcgcgcgtactactggcagcgcaggctctggaccgctaaggaggccgcgcgcgcccacgcgtgtccccggcagagcttccaggagacggctgcgaggcccttccacccgcggaccagagcgcgccgggtcgaaccacgacccacgtgcaggccctcgcgcgctaccggaaggccagcctgtggcgcacgcgcgccccgccccgccgatcggtgacgtcatcgggcccgtcacgaggcgggggcggggcctcggaacgcgacgccccccgtcccagctttagccactcgtgacgtcattgcccggactccactgcctcctgcgccgcgcttttgccaccctgggcacgtcatcgtgcgccgacgccaaacgagggcggggcctagggacgccacaccttccgcgccgccgctcgttacgtcatcggacctcgccgcttggcggaggcggggaaggcccgcaggcggcgcctcagccggggttggcgctgaggggagagggcggggaaaaggtggcgaattgaggggaaagtgggaggggcgggaaaggggcggtcggaacatggcggaccagatcccgctttacccggtgcgtagcgcagcggcggccgcagccaaccgcaaacgcgcggcctactacagcgccgcggggcccaggccgggagccgaccggcacagcaggtaaccgaggcggcactggccccgttccccgccgacgctccccggggcccccagcccaccgcaggaacccggagccgggcgggtctggggtcgctaccggcgcgccccatctgttcgctgggagccgggagtccttggcgttctgagcgcgccgcagctgtggcgtccgccggtggtgagggccgcgggcagctgccggggcgagcggctgcatccccgggacgcctgggccgagcgtaggagccagaacgggagcagagaaccgcggtccagtgttgaggggtggctgctctcctaaagtaaacggggatcaaaagtgctaacttctcggatacttcagagtctccgaaacttgttcttgtagccctgtgaattgtgaaggtgacggatgtaacttttaattgctttgttaaaaacacacttcttattgaaatga

SEQ ID NO: 11221 - DNA, 1162 bp, Homo sapiens
acagacagctacatactgtcgaaagtcacttctagaatgttggttgatgacttaaagttgtgtaacatagagtgtttagatgttgcttggagtgaacattctttgctatagtcatgtttcagaagattggttttttctgactggattaagtgcagtgaggagctgttgagcagcattggttgtgctgtcaggctgcccatccgcaccacagatgcctccaggattatgctcacagcacggttaacagagacttcttcagctagcacaggtctcgttgggcagcttttttaccttagctaacttattcctttgcaaaagaaagcagcctctgcagtcttatttataatgctttccctcagctgaagacagcctaatttgaggaaatattgtccctaaatgaaacacactgtaaagaagactgcttggcctatctcagcactccatttttaccctaactaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccaggtttgttatccattgctacctaatttccttatatgctaaggttacttataaggttagcttctaatatacttattagctatattaatataaaaactcaaggagatattccttaaatgatatcatggagattatcagtacattaatcaaagccaaacaatgctaatatgaaaggaaaggaaagccaaattattatcttacgagaagttttaatggttaaaagctggaggccgggtgtggtggctcatgcctgtaatcctagcacttcgggaggctaaggcgggcagatcactttgagctcaggagtttgagaccagcctggacaacatggtgaaaccccatttctactaaaaatacaaaaattagctgggcgagattgtgagctcctgtaatcccagctactagggaggctgaggcaggagaatcacttgaacctgggaggtggaggttacagtgagccgagatcgagccactgcactccatcctgggcaatggagtaagactctgtctcaaaaaaaaaaaaaaaagctag

SEQ ID NO: 11222 - DNA, 1100 bp, Homo sapiens
agaggctgcgtgtgcagtggctcacgtctataatcagaacactttaggaggccaagacagaaggatcgcttgagaccaggctgggcaatgtagggagtcactgcctctacaaaaaacaaaaaaattagctgggtgtgttgtcgtgcgcctgtagtcccagctattcgggaagctgaggcaggtggatcacttgagcccaggaggtggaggctgcagtgagctgtgataatgccactgcactccagcctgggcaacagagtgagacccagtctccaaaaaaaaacacacaaaaatgttataaaggtaccttgacatgctagggagaaaatatcttgttcttcctattaaaatgaaaatagtagcaagtaacaatcttaacgctactttgtattatacagttgggcatcccagctgcttcagcccatgaatgtgcagcatgcctgcatggtaggaaagctgggtgttcccgcaggcctcctgcattaatgtgtttgctgttgtcccctttatcctaggaaccctcacccagaatgaaatgatatttaagcggctgcacctgggcaccgtgtcctatggcgccgacacgatggatgagatccagagccatgtcagggactcctactcacaggtaagtgggttcctcctgcacggggtctgcttccacacacatcccgcgccatgagtccagctgagcctcgtgtgttcccatctgtaaattagcacgcttcttggtggtcttaacatcctgctacttcagtcgtctgttcgaatatacgaatcaggaaatcgtctttgatgagcatttgtacatgagtgaaatcgtagaaggcatagtgtgctgaagtcatttattcatatcacattttactagtgagttatttgtaaaaaattattcagtaaacattgtagttgaagaatgttcagtaggatactacatcaatatgttttctaacagttctgtttttctctataataaaatgttctcatatttttaaaggtaaattctttttttgccttttcggtagataaaagtagacaccatcgtgttgggaatctcgtatctgtcattcacctacctgtcatcagtgcccaggtggtga

SEQ ID NO: 11223 - DNA, 1163 bp, Homo sapiens
agaaatgatgctcagtctggtcattggagccctggagacagatggtgagtgtctgtgctgtgcagaggcagatgtctcactgcaaggcgggagtcctgtgaccaaacagcacctggcacattgtcagatagtagaaggtctaagcctgccgtgggaagaggatgcatctgcatgtacctcagtacagaggtacaggagatgacttcctctgacccactcagtgagttgtaaggagaaaaggcagcatcgagcatttttgattagtgtctcagggcaagtggctgtgaggcaagcgtggggtcagggttccggtttggttctgcaaaccaggtggtttggtttgcgggtcctggtgaagagaggagggaggttttggtttctggggccctacttcacctggggacatggtgcggcagcaggaggtggcctccagcagcatgccagagccctggcttgggtgggaggggcgtctgcagctgtcgttttcatctcctggatgttgtttgtcttgaaaacccatgtaagctaaaaagtgacctgtggaggggcggggtctcaggtttccctgactccagacttctcagcctgccgagcgtactggaagacaacgctctctgctgagcagaacgcacacatggaggctgtcctgcagagaagtgccgcgcacatgaggtgatgacctttgctttctgaatgtacttgctttttgctcataccctaaatttctcagctgtttcacttgtaggtggacttgaacttttcattgagtatttttgcttttaaagaaaattttggaggcattttcttgaagttcatagtataatttgcatttttgtataagctataatgtaggttagcatttattaaagtgtgccaggatcactagggatctggagatcctgtcagggagttcattagggtaagacgttatttcacctctcctgctgtgttgacatttgcactgagggtacagaaaccatgagggaagactgctggtgccatgctgccagccagtgctgtaggggcgccatgccacatgcctagagtaaaagacaatgttacttttacttaagaatatcccagatgaggctggacatggtgcctctcacctgtaatccccgcaactcgggatgccgaggcgggaggatcacttgaggccagga

SEQ ID NO: 11224 - DNA, 1156 bp, Homo sapiens
tgcactcctgacctcgtgatccgcccgcctcagcctcgcacagtgctgggattacagatgtgagccaccgtgcccggcgcaaatgcatttattgcatacaggacggtgcacctggactgtgctggccgaatgcttctgacactggagaaggcggaaaccaaagcccaccttccttcactcctgtctccagttaccctcagatagacgtttgggagggttctcaggcgagtagatgtaggaagtgtgatgtgctgttgtgttgtggcgacgacactgtggactaggggcatggtttgtgcttggtgtgaagcctcttcttccttcccagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaagaaaatggtaaaatagtgtctctgagatgctggcatggccacctccacctgcagagccctgccaggtgccagtgagtgcttggcccgaggggtcaggccacagcagtggccggggtaagaactgaacctgcaaacctggggagaacagagggtccccagagcctcccaaccccctggagctgggctccgtccctggggctgctgggctg

SEQ ID NO: 11225 - DNA, 1170 bp, Homo sapiens
atactattttgtgacatgtggaaagtatatgaaattcaaattggtgtttgtaaataaagttttattggaacataaattacaaattattttggggacttttgtacaacaatggcagtgctgagtagttgccacagagactgtactgtatggcccacagtcctaacataatcactctctggcccttcacagaaaaagtttgccaacccctgggttagaaaacattaagtcaggttaaatgcctagcacattagaagaaaagggatcaagtcctcagggactgtggaaggttagcatctgacagtttattcaattatgcttaaggctttcttttcttttaacagagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaagaagcatgtgctggtagcccattttcactacttaattaactcctactttggcctaagaactgaggaaatgggtgagcaaccgaaaactaacgatactgtttctatagagaagatcccaccacctgacaaatattactgtaaaaagtgcaacgccaatgccagcagccaggatgcgttaatgtatcacattttgacatcagacatacacagagatttggagaataagcttagatctgtgatttcagaacatattaagaggactggactcttgaagcaaacgcacattgctccaaaaccagcagcacatttggctgcaccagcaaatggcagtgctccaagcgctccagcgcagcctccttgcttccatcttgctttgccacagaacagtccaagcccagccgcaggacagccagtgactgtggcccagggtgcccctggaagcctcactcattccccccctgctgctggccaatcccacatgactctggtctccagccctctgcctgtgggccaga

SEQ ID NO: 11226 - DNA, 1100 bp, Homo sapiens
gtttgatttgtaacagaacagttgttttcaggtttttttctctgtcatgtaaatgaaatcttttgatatttcatgcacgccttgttttcccactagtgtcagtatcgtatgataagaaactgaaatctataaataatttgctttttcattaaggacatttcagcctttttcagaatacttgatttaactgcgagtggaagcatcgatctccttcagctttccctgtagcagcagatggtacagtgagtgttcagagacgtgggtacaaaccctgtgatgtatgtataaggctccctgaggatgcactgcattaacttacgctgacttctttgtaagatctttgcttatagattataatttagatctgtatttttttaggtttatcctaatagctgtttttttttttaaccataactcatagaaaatcaaatgtttttatttgttaaaagtagactgaatttgacatctggtatgctggtatgtagctcatacatcaagagttattttacaaataaatttattctgtagatgcagaaatatttttcagtgtagattttcccttttgatatgctaagtcatttctccgttcagaggtaaaacaataaatttttagtgcctttagaataaacattgaaagaatacaccccaaaactcttctcctaacttaactactcataaactagtgaaagggaaggtctatgatactcaggaataagattattgcccctgagtgtgaaaactaacttaaatttcagcatagggtttcaggggacatggcgaagtttacagactgagatctcagtctccatggttggtacagtaagtctttcaccacattttctgaaggtcatgtttagtggagaaacgggcttttctctagctggtttaggctggaagctgtgtccgggtcgatgggatggcatattgttaaagaatctccattgtcgtcactgtcctgtggatgttaaacctcgtttttttccccacacgatattaaaacttaaagcaccagaaccagtcatggagaccagccagtttagatggtaagtcatatttctggtggtacacagcagaggaaccccttcactctatctttaggt

SEQ ID NO: 11227 - DNA, 3119 bp, Homo sapiens
gcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagagggcaccacactgaggcatgccctgctcggaccccagacgctgtcatggccggagctttgtcataactggggctgggacggccctgggagcacagagccttttgttttcaggctgactgggaagacggtcacagggtgtggggtgcagagcagggaccagaggtgtggggttcatcagtcggggagaagggggtctgttggttctctcacctgtggggtcttgccagcctggctctgtccttggggccgcacggggaccccaggagttcttttgaggttcagacttgactgggacagttttgctttttcactgtgccgtggttgggcccctggagaaccctgggtccttggaggcgtcctgcagagctggtacgcggctcacctgcctgctgtggttgcagggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggtgagaagccaaggaggctgggggtcctggacccagccctcaggactgggtgagaggcctagactgggggtcccggacccagccctcaggactgggtgaggggcctagactgggggtcccggacccagccctcaggactgggtgaggggcctagactgggggtcccggacccagccctccggactgggtgaggggcctagactgggggtcccggacccagccctccggactgggtgaggggcctagactgggggtcccggacccagccctctggactgcagccctccagactgggtgaggggcctagactgggggtcccggacccagccctcaggactgggtgaggggcctagactgggggtcccggacccagccctccggactgggtgaggggcctagactgggggtcccggactcagccctccggactgggtgaggggcctagactgggggtcccggactcagccctcaggactgggtgaggggcctagactgggggtcctggactcagcccttgcctttggtcccctaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatggtgagccgtctgccctcctgcccacatgccctgctctcggggtggcccagggccactcctggtccgtccctgccagccccaccgctgacccagagcttggaactgaggagccccaggcagggagttgatgggaccccgaaagaaagtgtgggatggagggtctagccccgggcagctgcggctcagtgggcagcgggaccccgggaggaggaggcggcacctccgccccacagcctcacccggcccttccctcccgctcacttggctgcaagccagtgtcctccgtggtgagccggcccttgctgctctgcatgatcaggctcgggaacctgaggtcagccatgctgtgctccggcagcccctgcctgcctcctcgcggagcccttctgccccttgggctgcgtgtgccggggcgaggcctgtgtggggcctgtgatggcagctcctggaaaacgctgtggggcaggggtgaggcccacgaggccatggggacagctcaccatggggagc

SEQ ID NO: 11228 - DNA, 1374 bp, Homo sapiens
ctcgagtgccctgtgtgcaaggacgactacgcgctgggtgagcgtgtgcggcagctgccctgcaaccacctgttccacgacggctgcatcgtgccctggctggagcaggtgagtgccccgcccacccgcccccccaccccgaccgcggccctcccgcctctaacctgccccttctcccgtccctgcctctgtccccacaaagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaagccggtgctgtggctttccttctgcgcccgtgcgtcaggaaaaggccaagctgggaggctggtcgggctctgcagagtccggtcctgtctccaggggtctgcgcctcctgcagggcttggcacccagggccggctagcaaaactgctctcccgaagttaagcccaggagggctgctggcgaggtagcagggtggcagtgtcactgggtcgtgaaatttaaaaccagaaacaccagcgttaaagcgccagggcccagcgcctctgccccacgcttcggtcacacctcagccacgcgggttcctggccccttctgaaaagccggaccccactgctcaaggttgctggatgcctggcccggggtgcagccagctcgggcacagctggcaaggcgtggggacctgcgggctcagggggccgggg

SEQ ID NO: 11229 - DNA, 1181 bp, Homo sapiens
atcacgccattgcactccagcctgggcgacagagtgagactccgtctcaaaaaaaattttttttcctcattgtacggcattggctgcatccacagatgccaacagggggctttaattgtctgtcagttctgacggtgtaatctagttcgtgatttcctctttagcctggaggaggatacaagccttgccaaggtttccctcctgcctgagccaggtcactctctctgtccctcctgcctggagctgggtcattctctctgtctctccttgtacagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcc

SEQ ID NO: 11230 - DNA, 1186 bp, Homo sapiens
ggggaacctggccttggctgcctcggcggcggccgtggacgcagggatggcgatggccgggcagagccccgtgctcaggatcatcgtggagaacctcttctaccctgtgaccctggatgtgctgcaccaggtgaggtggtcccatcaccgccagggcaggtcggctgctattgctgtgggcacaggcacacgggaggggcctggcagggctggtgggcaccgggcaggagctcatgctgtggcccgggacctgcagattttctccaagttcggcacagtgttgaagatcatcaccttcaccaagaacaaccagttccaggccctgctgcagtatgcggaccccgtgagcgcccagcacgccaagctggtgagtggggctcccgggacggcgcccgccctggccctggcccggcgacgtctcacggtccctctcccctcagtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtaagaggctgcccgacgcggcgccagtgtgcagagtggtctattagggccgctcagtccggagccccggcggcacgggcccggccctgcaccagggtgatgcacctgctgctctctgcacggccagcacagcacggtccagtgtcccccacgtcgggaccacggccccccctggagcagcggatctgcccgcgaaggctctgccggggccgcccgccggccgggttggggcccatcccgcagcacagcgcccgctcgcggtggaggttgtgggtgcgatgattagtgtctcatttatttctaggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgt

SEQ ID NO: 11231 - DNA, 1186 bp, Homo sapiens; identical to SEQ ID NO: 11230

SEQ ID NO: 11232 - DNA, 1883 bp, Homo sapiens
cctgaccccctgtcttgcaggaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgcccgcgccctcggcccgccccccgcccgcccc

SEQ ID NO: 11233 - DNA, 1496 bp, Homo sapiens
aggcatgtaccagcacaccggttaattttttaattattatttttttttgtagagacaaaaaaataagtcttttttttttttcatagtcttgctatgttgctcaggctggtcttgaacccctgagctcaagtgatccaccggcctcagcctcccacaatgctgggatcaccggcatgagccaccacacccagcccgtcttcacaattgtatctgcttcctgtgatgtgaggatgaaacaaaataggattttaagggcccaggacttcacacaccgtaggggtgagctctccattgctgggggaaaccaagcgggccatggctgtggtagggcccttctcggagatcctggccggccttgaccctgaggaccacccctgccccggcccacaggccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacagtgagcaggggtcgggaggcgcctcctgggggctcctgggccttgtagaatggcatgcatattggtgttatctgttacccctcccatgagctgtgcctgggtggggctggggacccaaagaggtgtcagctgtaggccgggggaccatataaatagagccagacacaggcgccccctggactcttggatcagggctgggtgggagggcgccccgggcattggagctggggctttaaaggatatataggagttcgacaatccagaacctggggtctaggtggtctctgtaccttctggggaagacagttggagcatggaggtgcggaggttgagatgataaaaaaggaggaaggctagttcttgggtccccatggtgcctgggggtccccaaatgccaccccggcccagagagcatctgtttccacctagcccagtacctcctgaccctgctggagacagacgggggcctgcctggcctggaggatggggacttggcaccccctgcatcaccaggcatctttgccgaggcctgcaacaacgccacctatgtggaggtgtggcccccaaccccctcactccctccacacggggaccccggcagttctcctacggccaggccatcgcctgtgcccgtcccccgccagaagcacccgcccacttctgatctcctaatgaaggcccctcagtctccttcggggtccccagaccaggccagaatccccaccccacccctggaaccttcgagctcctggattcacctgcccaacacgtttgggaaccctccaacgattgcaggagtgtttcacctcaatcccccccaccccgagacagctgggcccaccccggttccccgcttccctgcgctcagctcagggcccgacacaagcagcggcccctcagtggacagaggtgaccgcaggagcgcgtccacgtgcttggcggccttaccgt

SEQ ID NO: 11234 - DNA, 1175 bp, Homo sapiens
ccgcaccaaccaccacacccggcccacatttgtattttttgtagaggcagggtttcaccatgttggccaggctggtctcgaactcctgacctcaagtgatctgcccacctcagcctcccaaagtgctgggattacagccgtgagccaccacgcccggctgagttttcccattttagagaggaggaagctgaggcttggggtcttaggttggacattatggatagaaggattggggcacaagcctactgggctcttgggccccagtgtccttctggatcctctttgttctgttcctgtactcctcccacccagggcccctctgaccctcagaggaagcaccaacctcacatctaccacctccagcctcgaagcctcttgcaggggcgaacacttccttgctggaccatgcatttgctcaaaccaccctgctcccgactcctcttcctggttctctgacttagccattgcccaggcgtcccctcccctcgccctccactgctgtagtagctcccgtgtcctgcatggggctcacgaggctgactgtgcatccttaggaccagctccagcagaagatcatgtgccccgggcctgtcacctgtctgactgcatcacccaatggtctctacgtcctggcaggagttgcagaaagcatccacctgtgggaggtaagaggagcaaagcgtgagcgtttcccacaggacatctcagcccatctgagctttgcctgcagggcaccagggaacaaccatgcggcctggggccctgggatgggtgactgctcaggggttatagcctaagcttcaccctgctgcctcctttctccaggtcccctcgagacttgcgaatcccagaccagccctaatcctgccttgagtgcttggatagagcccggtgcagcccagtccccggcactcacacaccgcagcatcttccagggctagcgggcatctcttccacgcaggcggcagcgcctggcacttgtgacttgaaagttataaagggcggccgggcgcagtggctcatgccggtagtcaatgcaacctctgcctcccaggttcaagcaatcctcctgtctcagtctcctgagtagctgggattccaggcgcccaccaccacacctggctaatttgtttgtatttagtagagaagggcttcacaatgttggtcaggctggt

SEQ ID NO: 11235 - DNA, 1178 bp, Homo sapiens
gcgagcctgtgcttccagcctcatggggccaggcctgtccatcaggaccacttccctgtgtccagatgagggtcgggtccgggccatggctacttcactcatgagcagtgccgcagccaaccaggctcccacgatcccccacagcctgcttggggtcacccagcacctgagcagcccccaggctcctacaatctcctcacagcctgcttggggttacctaggatctgagcggcccccaggctcccacgatcccccacagcctgctcggggttacataggacctgagcggcccccaggctcccacgatcccccacagcctgctcggggttacctaggacctgagcggttgccaggttggggcccacgtgcaccatccccacgctgggccaggtcaggccaggatccaggacaccctctcctgtgctctcggggggtcgtctctagggtgcgccccggctacgggactgaccctggccccagcccacagtcccaggcctggacaccacttaccctccacccgcccccctagaccttgctcccggtatcgaggagatctacgaggagagccagcaggtgttcctggctcccgggcacccgcaggacgggcaggtggtcttctacaaggtcagcaggaagccccacagcccctcacactctgcccaccccgcccccaccacactcacacccccccaccccgtgccgtggcagatcagcgtggaccgcggcctgaagtgggaggacgcctttgccaagtcgctggcgctgacgggcccctatgacggcttctacctctcctacaaggtggggtcgggcggggttacccccccagaggagggcccgcggggggcggaccggggcgcggcctcaacgcccccctccgcaggtccgcggtaacaagcccagctgcctgctggcggagcagaaccgcggccagttcttcacggtgtacaagcccaacatcggccggcagagccagctggaggccctggacagcctccgccgcaagttccaccgggtaggcggccgccgggcgcagctttcgctcgggttgccggccctgaccccgcccaggctcatgcggccctgtgtccctaggtcaccgcggaggaggccaaggagccctgggagagtggctacgctttgtcgctgacgcactgcagccacagcgcctggtgagg

SEQ ID NO: 11236 - DNA, 1145 bp, Homo sapiens
cggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggccccc

SEQ ID NO: 11237 - DNA, 1516 bp, Homo sapiens
caggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcccaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagggaaattcaactactgaggaggttacggcacaaaaatgtcatccagctggtggatgtgttatacaacgaagagaagcagaaaatatatcctttccggtgttgggaccgcggggcctccgtgggaggggctggggccctgggtccgcctgcctcgaggcctgctcctcttcccgtctccttgaaggagactggcacacgagggccgtggccttccctggttccccggaagtcagccattgtggcaatggctgcgcagcttgctgaaaggggccctgagccctggcccctgtgtcttgggcccgtggggtgtcaagtcccttttttctcagagtctcctcccaggctaaccaggggtgtagccacggtctgcctgagacaggccacgcgggctgaccgttgtgggccattttggtcgtggctgggcgtgtcctcgtgtcatctgtggacacccccatgggtcttacgggcacagcctccctacggggactttgcttcctaaggccctgtgcccagagcaagagccagaagtggtcctgaggctggggctgtgttccctgagccacgcggtcaggggccctgggaccgtcctgcatgggcccgagcctgcttgggggggcgtccaggaggcaccatcccccgcccatgggcagggtgggggacgtgagccccgcaggaacgctgccccaagagtcagccctgtcctccccttccccgtaggctccttcctcctgggacgctggggcccctgggccttttcagaggggtggctgagggcagggtgggccctggtcccgaggaggggcaaggtgggtgcagagggtccctccagagccccttttctggcccccgtgctccctgggcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcaggggccagggtggggcgg

SEQ ID NO: 11238 - DNA, 1201 bp, Homo sapiens
ctagcagggactgggggcagctgggggccctggcaggctgagctctgctccccgcgtggttctgtgctggcatttcgcgtgcctggcctgagcctggcccgagcctggccctcctgtgtcctcacagatgagcatgtggcggctcctgggcctctagaaccaaccatgggccagggtgccccaggggagcacgggagggtcctgccttgtcagcttgcctcctactcgtgaggttcctgcagtcagtacctgggtggggtcccacctgcggccatggcaggtgcaacagacgtggtggaggggacactcctgcccaggccatctgcgggaggctcagccccggggggtgcctcccagagctgctggggggcagcatttcaggctggatacacctgggcctgacccgggggcgggcatggcctgggcagcagctgtaagtgcgtccccgtggtgggggccagccaggtccctgtggctctggggttgcgcccctcagctcaggccacacttgccgtctccctcccaggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcaggtggggcgcggcggggcccgggtggggcatgtggggacaacgcctggatgccacagccagccgtgagcatagcccgcgctagtcagtcatggtgaccgtcacgtggctgcgcgtggttgccatgtggcctttgggtggcttggccacgtagcgatccccgtggagggtgccgtctcggggcctggtgtctggccagcgtgctggtcatggaggcctacgtgtggcggggctctgggggggcgtgccgtcctcacagccacctctcagagtgggtgcattccgaggaccctgccctgggcctggcgccccctccccatgcccgcgccgcttccaggaaaggcttatgctgggctcagcccagaggcttttgagcaccagtgggtggtgggtggtggggaggggccgcggcctccatggctctgccggggtgccgcaggctctgagccagctgccaagtatggctga

SEQ ID NO: 11239 - DNA, 1204 bp, Homo sapiens
ggccgcggcgcaggcgacgacaccgagccacctgccgcgcccgcccggccccgcagcccgcgcgcctggccccgccgcccgcgccgcgactacagcatcgacgagaagacggacgcgctgttccacgagttcctgcgccacgacccgcacttcgacgacacgccggctgccgcgcgacaccgcgcccgcgcgcacccgcacgcccgcaaacagtggcagcgtggccggcagcacagcgaccccggcgcccgcgcggccccggccctggccggaaccccggcaccgcctgccggcgcggcccgacccgcgcgtgcgcccttgcggcgcggcgacagcgtggacggcccgcccgacggtcgcaccctgggcggcgccggcgacgaccccgccatccccgtcatcgaggaggagccgggcggcggggggtgccccggctcgggcctgtgcgtcctaccatccgggtcggtgctggacaagctggcggctggcctcgacgagagactctttccgccgcgcctcgccgagcccgtcgtggcgactcccgcgttggtcgccgccgcccccacgtcccccgaccacagcccggcctaagtcccgcgtcctgggcccatctctctggcagcttctccggcgccgcacggggcctcggcggcgggagagacgtgggggcgcgacgccccgacgcgaatgcgcggggaccgcgggcccttcgcgcacgcgccgggcgacggaggcgcgctcgccgcttcagggcgcaggcgcagagccccggccgccctcgcgccgccgaagtgtgcactgctctttccggtgcttgccgggtgctgggcgtcgtgaggcgcgggccgcggagaccccggctgggcgggaaggaaggggcgtgaacggctctcagcttcgggctcctgaggacaacgatcactcgccctcagtcccggacggggcggccgcttagtcgcagggcccgccacccgagggtcgcgcagcccactgggcccgatggagccgccgcgtgccgggcgcgtgcgcgagctcgcccgggcgggggccgcggggcgctaacggtcgcagacgagttcgccgccctgggccgggaggcggctcaacaccgtgactgccgacctccgagaccgtttacctcactgcggcgtgtgctggcggcagcccgcgccgcctccgagcaataaccgcgccgccaccgctg

SEQ ID NO: 11240 - DNA, 1106 bp, Homo sapiens
tgccactgcacttcagcctgagcaacaagagtgagaccctgtgccaaaaaaacccctcaaaaaaccatgttgggagggctgatcagattaggggaggaaggtcatttgtgcaggaaaaaaagcagttctaagcctcactggtttccagtggtggccagatttgaactcagcttgcctttggccctgaccccagctcaacccatgggtggtgggtcagagggagggcctctgtccccaggcagtgcttttgggggttcctccagcttctagtcctttcttgcggcccctgttttgttcttctctagcagttgcccgccatgttgggcccagggccagtcctgtgggtctgtttgcacactcaggacacagacttggatgtttgtggagctcctggttcacagggggctctggacttgaccaggggagtccctgaggctgtgcagccctttggggtctcacgccttccccccgccccattcccccagtgagcagcggttccatcgcagtgaacgccgactcttcggtgcagttgttggccgaagaggccgtgacgctggacatgttggacctgggggtgagtgtcagaggggacctgaggctcagcaggttggagctgtccaggctgcgggggagggagcgctgggggaccaggagccgggctggggtcgctgctggcccctcaccgcccctcaaccccttgcaggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttac

SEQ ID NO: 11241 - DNA, 1117 bp, Homo sapiens
ctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacgtaggtaccgcgcgcccccggccggccgccccctcgggccccggcccccgggcgggaacaaagagcgcgccgcgcggggaaggcagggggcggccagacagggggcgggggcgcgccgcgcgctctcgggcgccctctgctcggcctcgcctgcctcggccccctcccccgcccggggtcgccgcacaaaggcggctgcgagggcgtcccgggccgggcttcggcggccccccttgggggcgggcaggaatcccagggcgttgcgggggtcccggctgcgggtgtgggggccgccaccgccccctcccgcctgcgtccgcgccggcttccgcatctgctcggcggcctcctctgcgtctggctgtctccccccacttgcgtctctctccccccctttgttctcgcctccgagcgctccccgcagcctcccctcccccctggtatttaaatcgcctgcaggcccggagccctccccccgcg

SEQ ID NO: 11242 - DNA, 1295 bp, Homo sapiens
actttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttttcttgatcttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggt

SEQ ID NO: 11243 - DNA, 1127 bp, Homo sapiens
gggagagcgggaacggtgggggaaatgagaagccacagggatggaggagaggggagggagtggccaaggagatctgagagggcttcctggaggcgtcgcacttggtatgtggacccagatctagttaacgcagagagttcccggttagacctgcgctactactcgcctgtagcccacgcgctcagagagtggctggagccccctgttgaaatggtgggacttaggatacactgggttcgaggaactatgtgatgaggacagatctcacccgtttctctctattttatgtatttgaatgtggctggtggggcgcgctttacaactcttggggcccggaggccacctgcaggagccgctgtgcctctcacctctgccggctgccgccccgggacatgagtcgggggttctgggtgctccacgtggagtctcacgctgggccacgcggggctccgggggtggcgtctgacccgagcccggcctccgcagagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtaggcctcgtcccagccgcccagccgcccccagagtgagctgcgcacggaccccgcctctcttccaggtctacgaccagatgccggagccgcgctacgtggtctccatggggaggtgagtgcagggcggggggtctccagggacagacgtagcgtgagtgctggcctggccgtgccctgatggcgcttatcaaaagtgtcatctacattcagtgaaatcccacgtggtcccggcgctgcccttcagccgtctcggtgcctccaccctaggcagatgcgctggtgggcctctccccagaacgattcctcccatccacccccacgcagcagaccccacattccgcccagttctctgctttactcacacataagtgatgacaggtgctgtagatagttttataatctcagccttctcacttgccattagttttttttctttttttttttttttttgagacaga

SEQ ID NO: 11244 - DNA, 1052 bp, Homo sapiens
tcttgagctgctggaggtttccgtagccatcattgtcacctgctggagatgtacagcctgaaatccagcttcctctctgctcatttcgtcgtcgctgctgcctttcccctgccgtcctaaagtccctgccttcacactggagcacttttccacgtggcagtggttgtaattcggaatagctgaggcaaggcacgcactgtgtcgtgggtccgtttagctgaaatgtagctctgcagaaatgctcaatccctgtctccttgggtctctctagaaaagtgagaaagtgtctcagcagagcccagtgtctttggacttagcgggcttgtggagtgttctgctctggctttcagctgactctttaaaccagcgcggattggcctttatgtcctccgcagctcgcgggagggtttggagggttcccgtgtgaactaactatccttcccttcttcaacagcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggccttcttggggctggagtggccgagccacaggtgcacgggcctttcaggctgggagctcgctgtctcgtatttccccaacgcctgcgccctccggaaaggtggaaagcccggcctttgccttcatggccatttcgtgtcccagtagggtggttgggcggtgaaccagcctgacagccttcagggcggccgcccgattccattgtgaacaccgtggggtccagtgtcagagaagggcagttacacagaaacggggttcagtgtggcctgggcgagccagccccacagagctgactttccactgggcaggtgggagaatgcccgagctccgttgagcccagtgccagagggagctgggacagccggagggggccggcggggagccctcctagtcacccaaggcaggggcgtgtggtcaccccaaggtc

SEQ ID NO: 11245 - DNA, 1402 bp, Homo sapiens
ttgcctcagcctctcgagtagctgggattagagggcccccccaccacgtccggctaatttttgtatttttagtagagacgagtttcagtgttgcccaggctggtctcaaactcctgacctcaggtgatccacctgcctcggcctcccaaagtgctgggattacaggcgtgaacaccgcgcccgaccttgatttttgattatttgtggaaacagcgtttctctgtgtcgtccaggttggtcttgaactcctgggctcaagcgaccctcccgcctcaacctcccgaagtgctgggatcacaggcgggagccactgcgccctacctgccttcccctgcgtttttagaggcctttggcccgagctgtacgctgcagcaccttgtctgaggctgtggtctccgggccgcttgttctctctgaatctctgcagtcacacggtggctcttgcatgtgaggggtgagtcgcgcatatctggcgggggtgccagagggacttggcgtgttcattgtagtcactacaatggacagtgacaggtccactgcggctctgtccctggagagaaccaagccttagttctctgtccgccggagtgcgtagggtctccccaggccgggccgctcacaaaactgcctggtgcatcctccccagcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaaggtgtgtgcggccgtccctgccggctggggtgggctggggtcgcctgatgcaggcgggatcagctgacacccagctttgctcttggtctcccgcagcccgagatgatcggccactacctgggcgagttctccatcacctacaagcccgtaaagcatggccggcccggcatcggggccacccactcctcccgcttcatccctctcaagtaatggctcagctaataaaggcgcacatgactccagtcctttgcgcagcttgttcttcctggcgtcccgagctctgggaggggcctgggcctgcttcaggttcgtggtgtgaggaggttcaggttggacgttcgggggtgtgtggtagtgttgtgtggatggtctcttggtgtcgaagactgacagctgtgcgggccctgccccaactcggctgcccctgctcctgtctgcagggacagctgtggagctgggtgcccaagcccaggtgtgtagctccgtcccttttggccccctcagcgttcttgacctcggggc

SEQ ID NO: 11246 - DNA, 1762 bp, Homo sapiens
gcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgaggtaggctccccggccagggctgccccagcaccctctcccttccccacacccaggtgcagatgctggggtcctcctgtgcttgccgcccccggactctgtccatgtctgtctttgtggctggactcagacccagtgatgttccccagacaccccctgatacccactctcttctttacaagcctccaccccatccccccagccttctcaaggaaggaggtgagagccggaaatacaggaggccacacgtgatggggctctgcccccacccccccccccgacatcctaccccccactcccacctcacatctttctcctccctgggaccgtctcccacagagctctcccccctccctccagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggcta

SEQ ID NO: 11247 - DNA, 1197 bp, Homo sapiens
tgtatttttagtagagatggggtttcaccatgttagccaggatggtcttgatctcctgacctcgtgatccacccacctcggcctcccaaaatgctggcattacaggtgtgagctggtgtgagccactgtgcccatccgaagtgttccatatttttaagttaatgattgaaacagtttactttcaccaaaaaagaagagtgttcttttagcatcttagtagattcctgccattgagttgctgcagaatttctacacactttgttccaaaggtggtaaaactgtttccctttcatcttgtggtccttaatctgtctggcattggtagctacacatggcgtgaggtagggatccagttctggttgttggttttttgtttttatttttggccaagacctggtttttccaggaaagcccaagtccctcaccacaggagcacaaagagatatgtcagttggccctggaggccgacgcaggcccctgaccctaggcctgttgcagggctagggcgagcaggtgccacggcggccgccagcgagatcaagcgggaggagaaggaggacgaggagaacacgtcagcggctgaccactcggaggaggagaagaaggagctgaaggccccccgggcccggaccaggtgccaacccacccctcggcactccccaccctcaccccatcaggacgcacatgtgcacaggccacacgcacaccgcacccacactgggaggccgtcggcgggccccacgctcttcccccaacctcactgtctccctctggccccctcccggcgccctccccatagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgaggtcagtgggggcgcgggccaccagcgtccctgcagcgccaccctccctcgtgttcctgccctcgttctccttccccgcccgccttcctggagccagccctccctctgcagcagttgcctccttgcagtgactgtgcccttcacccctctgaccgcattgcca

SEQ ID NO: 11248 - DNA, 1261 bp, Homo sapiens
ggaccaacaccccatacttcccagcagagccaagcacaccgggcactgggccccggctctgcctctgaatgggaggcaggagggctttgcgaaagggggttactgaggtcacaccccactcggcctctcctagaagtcccacagagtctctggtcactgcctctgcctggaggggctctggagactcaaaggggcagggaaggggagggagggaggccggtgcctgggacacatctgaggtgcatcccttgcccgcagtcctacaccacatatggcctggagctgacgcgcgtcacggtggtcgacacggacgtgcacgtggtttatgacaccttcgtgaagcctgacaacgagatcgtggactacaacaccaggtgtggccagtgccctccacgagctgggagccctcccagccgcctctccccagggacccaccctcccccgccccaccagccagtgcttccaggctgagccctggtgcccctcctgcccgttcccccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtgccctgccggcccgggtcccgcgcggttctccagcaggacctgcgcaggccccacgtgcgctgatctctgccgctgcccacaggtcatccacagcaccgtggtggacacgtctgtgctcttcccccaccgcctgggcctcccctacaagcggtccctgcggaacctcatggccgactacctcagacagatcatccaggacaatggtgagtgccggtgcctgccctggggccgtccctgcgcaggggccgggtgctcaccgcatctgccccgcagtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagacc

SEQ ID NO: 11249 - DNA, 1261 bp, Homo sapiens; identical to SEQ ID NO: 11248

SEQ ID NO: 11250 - DNA, 1189 bp, Homo sapiens
acggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcaggtgaggcgcgcgggtgctggggctgggctcgggcagaggcagagccgagggcctggtgagagaccttctatctggagtggtttccagttggctcggaggcacggggtggaggcagctcctcagtgctggtccctgagcccgttgaaatctcaggagctcaggagcacccgggcagccctgttgctcctgttgcccctcacccacccagaggtcactggcccgtggccaccagccaggcttctgtggccacgtgcacacggtctgttcccactgactggcagggggatattggccc

SEQ ID NO: 11251 - DNA, 1210 bp, Homo sapiens
aaacgccagtgaacggcagcgcagggaacggggcggggccgctggcttcgcccaccgccacggtgttgggggctgggggtggccctcgggactggtgtggagcctgagcctgacccactgacttggctgagtggggagactggagggtcgcatccggagctgggcccggggacgcccgctggtgggaagggtgcgcgcgcgtcggaggccgcggctgaccctgctccggcgccgccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaagtgagcggcccgggcggggacgggggcggggcggggcccgggccgggcgcgaagtctcaccggctccacgaccctcccgcagcatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaattttagggctgctctccttcctttcatggctctgctcactctctcgagcgctcagcgagctcgaaagggggccggggttcccaggtttcgtccctgagtccctaggagagatcggcacggacccccttataggttttactctgcggaagtggggtgggtctctgtctagtccggggagcccttagggagctggttgcctgggcgatgatgggtggggcagcgtttgagcccaggacccctgcctgcttcctagggaggctggtga

SEQ ID NO: 11252 - DNA, 1136 bp, Homo sapiens
tcgcaggccggtgggacccggcgcctgtgcacgctcacgtagcggggcctgttcgggtccctcgtgggtcccttcagttcgagctctgtccttgcctcagcggcccgtcacccatagggtggcagagatgggccgggggagggagtgggcagcagtgcggaccgagtcctggcgcatggggtttccctggtgctggagccgggcgtttcgggggtgtgggcggggctggggtcatatcccctgcatgccccgcatgccatggctgtactcacatggcaagaggtggtgatcgccagctcagggaaggtgggggttccttcatcctgtggagagggggctgaattggggtcccctgagctgtagggtgcagtgcctgacaggccgtggggagggccgaggggatggggactgacaggccccgggcccatgccgccccctggcacgggtggatgccccgcctcccgggggtgcccagctggactgtggcacccccaaaggaccccacatgtcactgttcccccgcagggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtgagcagctgtggccgcgcctgggctgggtcaccctgttc

SEQ ID NO: 11253 - DNA, 1100 bp, Homo sapiens
ccttgggtcgaagggatgaggtggggcctccttcaagagacaaagtctggttctgtccgtgggttctctgtccctacagaaaaggagaacaacttcccgccactgcccaagttcatccctgtgaagccctgcttctaccagaacttctccgacgagatcccagtggagcaccaggtcctggtgaagaggatctaccggctgtggatgtgtgagtgcgcctgggggcaggaggcgggaagcgggaggcagggctccccgagggagggagtggcattcaggcaggggcagcccgtcgggggcccaccgtctactgaagccgtcctgggcctggtggtccctgcggtgaacgaggctggtgtccaggccccagtgtcttggcttgcacagttcatcctcgacatggggtcactgggctggggaggcggacagcgggtgccccattgctgggcccatgctttcccacggccacaccctcccgtgcctgctcatccgtcctccctctctcttcgcagtttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccggtgagcagagctgccgggggccgtctgcacccagagggaaccagggcccactctgcaccccagtcccagcccagctgtgaggagctgtccctttctctgcccagtgtgaaagacagttcacatctgggggtggcaaactgtggcccacaagccagagccaactactgtctgttttgttttgctttctagtaattttggctgggtgcagtggctcaggcctataatcccagcactttgggaggccgaggcaggcggatcacctgaggtcaggagttcaagaccagcctggccaacatggtgaaacgctgtctctactataggtacaaaaattagccaggcgtggttgcgggcgcctataatcccagctactcaggaggctgaggcaagagaatcgcttgaacccgggaggcagaggttgcagtgagccgaga

SEQ ID NO: 11254 - DNA, 1239 bp, Homo sapiens
tggctaattattttgtttttgtatttttggtagagacaggttttcaccgtgttagccaggatggtctcaatctcctgacctcgtgatcctcccgcctcggcctcccgaagtgctgggatgacaggcgtgagccaccgtgcccggcctattttttatattgtagtagagacagggtttcaccatgttgtttggactggtctcgaactccagagctcagacagtctgtctgcctcggcctcccgaagtgctgggatgacaggcgtgagtccccgtgcccggccgccatgctcattttctgtcttctgcctccctgtcctctgtccttgcaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctc

SEQ ID NO: 11255 - DNA, 1130 bp, Homo sapiens
gccatgggcaggggcagctcggtggctcctgtgtccctgcctcgggcctgcctgctgtcatctgcctccctccctctttcccagagcggccctgggcctggatacggggactgttgtgtggcccctctgtgtctgggggtgcgactgctcccctggcttcaggatcctcagggcttctacccgggattggcagtcatgctctcctggcagtacactctcccacctgtgccacccacccacccacccacccatcccgctttacagaaagccccctgagccctaccctgttcgtccccaggcagccacgccgagatctctggcctctgatgtcatgtgatgtgtgcttcccagctgggttccgggcagggacggtgctcatcatgccccggccttcagagctccttccagcccagcagtctcctggctgtgtcctctgtggcctccgccccgtgtcctcagtggccccgcgggggccttgccggtgctcacctgtgcctctgtttctctgcagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggtgaggccctgctcggtggtaggtggggtcgggaggctgctggcagggccgccccgagtcaccggagcctctggtggggccgcccggggtcactggagcctctggcggggccgccccatgtcactggcaggtgcgttgaatcatcagtccgtcgtggtgcgagtgcc

SEQ ID NO: 11256 - DNA, 1482 bp, Homo sapiens
ttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaacccaagtgtagagggatttgtctgggctttccacgaagcttgacctggaacgggcgttgcttccatccccatcctgcctgtccgggacgagtccggagcggctggcggcctccggtaacagaaaccgactgatgaggcggaaggtaaggaagatggaagcagagggcagagctgggctctgtctggggagagggcaggagacgagtgttcacgtaccatggaaaggggaagtcacacacatgcgacttggccccgggggtcccgttccccgacactacacaaatatacctgaaagcctcagcgacggggcccaggcaggatggtcctggctgctctgacggcggaaggcctccttgactccctctgttcacgcagcagggcagaaaacatctccacgggggccacgacactgtgaagggaatcagcagtagctcccagaagaacagcggaaactgcaggcaggtgaagaccttggcagcactagccccggctccgccccgtgccttctccccagacaacaccccataccc

SEQ ID NO: 11257 - DNA, 2039 bp, Homo sapiens
tggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgctgtgtgcctgagttttagttttctgtcaccgcataaggagccatccacaaccagttggtgcaaaaccacgttgttgctggtgatgctgagtcaggagttttgagggggtgcgctcctgtggggtctgtctctgctccaggatgcctggatgcactgctgggaagacaggcaaaaagctgagctcggctgggagcagtggctcacgcctgtaattacccagcactttgggaggccaaggcaggtggatcactcgaggtctggccaacatgatgaaatcccgcctctaccaaaaatacaaaaattagcccggtgtggtgcaacatgcctgtaatcccagctactctggaggctgagacacaagaattgcttgaacccagaaggcggaggctgcagtgagccgagatgatgccactgcactccagtctgggcgatgagcaagactgtctcaaaaaaaaacaaaac

SEQ ID NO: 11258 - DNA, 1137 bp, Homo sapiens
tgtgtctctgagggctgtcagggtcacaggtggagagcagcctccactggctttttttttttttttttttttttttttttgaggcgaagtctcactctgtcaccaggatgctggagtgcaatggcgcgatctcagctccctgcaacctccacctcccgggttcaagtgattctcctgcctcagcctcacaagtagttgggattacaggcgtgtaccaccacacccagctaatttttatattttcagtagagacagggttttgccatgttggccaggatggtctcaatctcctgacctcatgatccacccgccttggcctcccaaagtgctgggatgacaggcgtgagccctgctttctagagttgcagggcgttaagtgtggtgaattccagccgtggcagtggagtttctggccccttctcgactatgagcgtcccaccaacccaggtgctgtgtcctttcgcctgtttcagatcattgagaagcagccaggccacattcggagcagggttttcagggaggtggagatgctgtaccagtgccagggacacaggtaggtgagccacccttgccaccgcactggcctgagctgtctttcagtggatgaagggcctgagtgccacatcacccccagcaagcgtctgtagggcacccagtttcccaggccctgcattcccctccctgaagcaggctggctgacagccccaggcgggcagtgtgaagctggcctattgccccagtcccagcttccggtggacaggccagcaccaagagggtgggcccctcctaggccgggcagcaggtacccaggggcctcaggaagcctcagctcctctcctgcccccacccccaccccaggaacgtcctagagctgattgagttcttcgaggaggaggaccgcttctacctggtgtttgagaagatgcggggaggtacctgggggctccaggctgtgaggagggagggagctgggaggtattacgggatgggggcctagtgccacctgcaggagggggcttgtggggtgagtgtcctgcccaaatggtggctcaggggtgaggcctttgtgctggaggaagccagtgtgggggcgtccccgccaaagtggaggtgggtgctggccttgaggggactttg

SEQ ID NO: 11259 - DNA, 1214 bp, Homo sapiens
ggtgggagttgatcctggtgtgtgagcggggacggagttgatttttccgtaatgctcagcgcagggcttgtcagtgtggacgctgcgacactggggcaggataggtctccctgctgcgtgggcagggatggggcctgagtgcctctcctctcctctcccctgcaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtgggggccggccggccagggccatgtcctgagccccctgggcgtgcctcctggaacagacatgcccgccagccagcccattgacatcccggacgccaagaagaggggcaagaagaagaagcgcggccgggccaccgacagcttctcgggcaggtttgaaggtgagcggggatggcgggcattgggggagccgggagcggggaaaagccagggtccctctcacgcccgccccgctgcccggcagacgtctaccagctgcaggaagatgtgctgggggagggcgctcatgcccgagtgcagacctgcatcaacctgatcaccagccaggagtacgccgtcaaggtgggcccgcgccgcgccctggggaacccagcgccttgggatcggtgttgagcgggggtggaaacagtgtgtggcattccggctgtccgtcctacagccgggaagacccgtgtctaaaagtggccaccgggccctgagtccagtcgggaatgacagtgagggtggcccctctggtaccagggtgggggcttcagacagaggcactgtgcccattgggtcccctgggccgtccctgcctctgagctgtccctgagggtacatgacagtttggtttcaaggatcaaaatgcaatgtcatatcccagggcccagaggggctctgcgtttggggaacctcagtgcaggcccgtgagagccccctgtgtcactctagccctgggcggctgctggacccagggtgtggccgaagggctgggagcaggagccctgttgaggctctggttgtgaccctgtgaccttgtgggccggttggatcccgtgttccaagaaatcttccaggcttccctcgtgacctggcatccggctcccgggctgggtggggtcc

SEQ ID NO: 11260 - DNA, 1310 bp, Homo sapiens
gcctcggatggacctggctagagtcccaagggttgtgctgggggctggattctggggccttcttgggttccacggttccagtggccaagtctgccctctgaaacagggatgggaccaagtccaggccaaattagggacaccagtagcctcttgtttctgctcctgtcccctggtgctcccttgggggctgagctcagtttcctaatcagccacagaggacttgggactgaggacagacctggaggccccacccatgctgagcccccgcagcgtctcaggccccactccctctcgcccccgccaggcgtctccaacgaagcccagtatgtgttcaccatccagagcatcgtcatggcgcagaagctcaaggggaccctgtccttcattgccaaggtatgcagggctccacttggcgttgaagagccgactctgcaggcaggggctcctcctgccccatcgcagtgggtgtccaggtgtccctaggggaagtgggccacctgcctggggaaccctgagccctgagctgggcccgactcccctctcaactgcaccaccttcactccaccgcagaatgacgagggtgcgacccacgagaagctggacttcaggctgcacttcagctgcagctcctacttgatcaccactccctgctacaggtggggcccaggcccactcccctatgtccccgaaccccctccgcctcccctctaccttgcagacacctgtgccccggggactgaggcttctgggcaggactttagagacggatttggaggcgctggctcgtgactggtgcaggtcaggctgcctggtgtctgcgccagccggggccgtgtagttgaagccacaggccaggcagcgtcacccatagaggtccaggcccctggaagtcctgaaggctggaggggtgagaccaaggagccagcagggcaggctcctcctgaagcctctcctcggcacggcttggcgtgcggcaccccctcccccctgagtcctcacaggccgtcctctgcgtgcctgcatcctagcctatccccccagtcccttcctacaggacatccgtccttgtcggaggagggcccatcccatggcttcaggcacctctgtgacctctttaaagacaagtcattgtcagtttctgggtgtgacggcttccgcacatgaaaatgagccacaccttccaggacccccaagacctcccggcccagacacacaggagggtgtccaagcgcagcgtgtgtggcaggttttgttggcctctgtgccaggaagcctgaggagcccggccccaccgcagtcagcctccctgt

SEQ ID NO: 11261 - DNA, 2809 bp, Homo sapiens
agccggagcggggcgcgtcctccatgaggtcaggctaggcccgcccggtcttcgcggggacaagcaagagtcccagattttggccgtagtgcagggtggaaaggggaagccgcgacagaactgaaaaggggaagcgctggctgtcttggtggccggggggtgaggctctgccccggcggggctgcgtgaggggaaggggccccccgccctgggaaggttgggctgtcctgggcggcgccgcccgaggagtcggggctcagtgactgctgcccttgtaggtgcttggggcaggcgttggagctgccttcgggaagcctcgggggtgtgggaccgggtgggcccctgcctgggcggggcggggtcttttggccgaggcaggggtggggatgtgctgaaggccgcccggacgccctggaggggtctccgcccggagcctggcgctgcctcgtgacctgcatcatcttcagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgtgagtatggggccgggcctgctggggctgctctggggccacaggtactttcttgtgcaccttgctgcccgtacctgtgattgaatgtaatcgtgggaaccctgagtttcatcagagccggcgcacagtctcctgcagcccaggcgttgcctgagctcaacacggcctaggcccaagctttagcgctgccgggttcttggagtcctgtggggtgagtcagggttctgaattgggctgcaccccctggacaggatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacaggtgaggggcaaggacaggcagggagtgctcacccaggggagcagggaccaggtgaggggcaaggacaggcggggagtgctcacccaggggagcagggaccaggtgcgggttgctgcccaaggggtgcagggacagatgagggagggcactgccttcaggcagcacatatgggggccaccatcgctttgttggtggggacagggtccccccttttttttttttttgagatggagtcttgcttttgttgcccaggctggagtgcagtggcatgatcttggctcactgcaacctctgccttccgggttcaagcgattctcctgcctcagcctcccgagtagctgggcttacaggcgcccgccaccgatgcccagctaatttttgtgtttttagtagagacgaggtttcgctatgttggccaggctggtcttgaactcctgacctcgtgatccgcccacctcggcctcccaaagtgctgggattacaggcgtgagctaccgctcccggcctggggtccctttttaaaaagtgcactccaaattcgtaccctgggattctaccctccaagggatgccaggcagtgtcagagcttttctgtcatggggcatgcacgtgggtgggtgcagcggtgctgctcaacactgtggtgtcaggacggccccacccagaggacgatctgggccccagggggaccctggagtagagcgggcctcagggtagctgctaaggcccaggaggtaggcaggtgggtcgggccagccgagacgctgacactcgctgcagctttgcagttctcctggagttcgctgaggagcagctgcgagccgaccatgtcttcatttgcttccacaagaaccgcgaggacagaggtaggtgacccgtatcgcctgcagtagggtgcgtgggggtgcctgcgccgccccttcattctcagcccgcaggcacggtctccctgcgggggtggggggtgcgggcggggggttctggtcggcaggggttctgacggcttctcccccgcagccgccttgctccgaaccttcagctttttgggctttgagattgtgagaccggggcatccccttgtccccaagagacccgacgcttgcttcatggcctacacgttcgagagagagtcttcgggagaggaggaggagtagggccgcctcggggctgggcatccggcccctggggccaccccttgtcagccgggtgggtaggaaccgtagactcgctcatctcgcctgggtttgtccgcatgttgtaatcgtgcaaataaacgctcactccgaattagcggtgtatttcttgaagtttaatattgtgtttgtgatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatcccctccattgctctccaaaagccaataaagtgattacacccgatgcacctggctctgtggtggtgacgctggggactggtgggaggagtgcctgggaccacagagggccctgggtggaggggtcgcgggggatttggcacccaggcagctgcgggacccctcccacggaggagaccccctgggctgggaggccgggccctcagcttggcgccagccttgccactgctcgcttgaagccccttcctgcctcgcgtccccttccgccccagcctgggcctgcg

SEQ ID NO: 11262 - DNA, 1163 bp, Homo sapiens
ttggaacccagaacagaatgtgtagctcacaggcgggctcatggggacatggaagtggaatggaaggctctagaaatagacactgttgttgctcagcccctccctggtggggaggtgggggcagccatctacctgccggctgcctccaggctggccctgatcatggccgaccttccttccttccttcctgcagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacat

SEQ ID NO: 11263 - DNA, 1921 bp, Homo sapiens
tgcacataggataggtcaggatccagggtttctcccgggctcactcaaaagctgtttcctaactacttagcacaaaacccttttaattgttttctgcacttttccatttgtctctgttggccagacgaagagacgagcttggtgaaaggaagcagttggagagagggagggtgctttctgatggggttgaaaaccactgggaggagcagacatgatggcccacttggtagtggggctcctcctggcctcagggccgtccccctctcctctcccaggatcaggaggaatcactgcctctcctctcccccgacccccttccagcaccagcagcaggtcttgggagccattgagagggccaagcaggtcaccgctcccgagctgaactctatcatccgagtatgtatggggacctgggcgggtgggcgggggacaggtgggccccaggcagctaatgttcccctcccccgccctgcagcagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcggtgctgtgtccctgcctctgtgttgtggctgcccccgggggaggacggggttccttccaatgtgagacatcctcctagaacatcaggagttcctagctgtggcccggtgcggtgtggctcacgcctgtcatcccaacactttgggaggctgaggcaggcagatcacttgaggccaggagttcgagaccagcctggccaacatggtgaaaccctgtctgtactaaaaatacaaaaaagctgggcgtggtggtgggcaactgtgatcccagctacttaagaggctgaggcagaagaatcacttgaattcaaggagg

SEQ ID NO: 11264 - DNA, 1117 bp, Homo sapiens
gattctgtcttcagaggacgctgggtgatgaccggaggtgttcagggagggccgctccgggcgtggagtggatggaggccagggatactgctcagcaccctgcagtgcccaggacggccccgccccagacagtgatctggccccagggtccacagggctgcgcaggagaacctgcctagagtgaacaagacctggtagaatccagcagacgccctgggtgaagatacttttgcagatgagaaggggtgggtgggttgggggaagccctggttttctgtgagtgcctcatggttcatgccgccctctgagggcctgcctgccctccagggacagtcactgggccccctgctaccccctccagggacagtcactgggccccctgctacccccaccagggacagtcactgggccccctgctaccttgccacccccaccaggccagcagccccctaagtgtgtgtctgctccacagcaattcatggagatcgagccggagatgctggccatggagaccgccgtccccgtgtactttgccgtggaggacgaggccctgctgtctatctacaagcagacccaggctgcctccgcctcccagggctccgcctctgctgctgaaggtgtgctctgggctgcagggacggggcccgtgggcgtgggtgtggggaggcgtccccatcccaagggctgcggtcaccctgggctgtttctgctctcagcgtgtggcatcccttcgccggggttaacagtgggggttcctgggccccgtgtggacctgctacatcaccacctccgggctgggacctgggactctgcatttttgcagccgcctgtcccccctcccagctgctggctctgtgcacacgaaagaccagaaccacggactcaggaggagcctttccgatcctcaggggctcggggtttatgaaacacacgggcatctgttcagttctctacctgccaaggacattctcagcatcacatctcgagtgggcggcgtgggtgcgtcggcggtgtccttacggagaaggggcacacgcctttcctccagccccgtgaacgggggccctggcagcgaactcagagcaggaacccggagctctgtggtgggacctgtggt

SEQ ID NO: 11265 - DNA, 1176 bp, Homo sapiens
gaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatgggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgt

SEQ ID NO: 11266 - DNA, 1120 bp, Homo sapiens
gttttagcagatgcagctaagatgaggtcaccccgtgttaggatggccccgaatccagtgcctggcacccttataaggagagggaaacttggacgcagacaggaaggccgggtgaagacagaagcagagaccgggggccaaggagtgcctggggttgcccagagccaccacgggctgcaagaggtgtgggacagactctctcagccacagaagggcccagccccgcacaggcctggatttcagagggcgaacatttctgtggccgaagctcccagtgcgtttgcagtccttggagacggccgcagacacatttgttcttggcctgtctccaggtctgtagaccccacagtgagcggccactggccggaggggaacaggaagagctggaggggacgtcacacacatgagccttttaggaataacgagtgacacgtgcaagaccccaaaccaaacaccatgtaacctgacacccagggagggagggagggaggggctgggaggggctcacctgtagggaggggctcacctgtacagcggtgctgggaagctggcctcgagggtccccgaggggatacagggccgtgcagcctcttgcctgagggtttgcatgtctgcctggatcccccgggctcctgccagaaggcctctgaggccaccgttgacagcataaaggccacccagtgtctcggcaaccacgctgaccactccctcctcccagctgcggggtgaggtggcctcgagggaagggctggagagtcgttctgagtatttaacaactgggggtgacacagtgtgggtgggcaaggccagggccactgccaggtggggtccgtggccctgagcccccagctctatgcaccccccacctggggtctggcttctccatctccacacccccttgaggggcttctgtctccccctgccccttcgatcgcaggaggcagtgcctggccggggtcgcaggcacctgtcaccccagctcctcactcctcacccactcacatccagtccgtttgtaaaatacacccaggatgagacctgcacgcagtggctcacagcagcacgatttgtgacagcccgaggcggagaacaccgaacacccagtgaaggtgaggggatc

SEQ ID NO: 11267 - DNA, 1097 bp, Homo sapiens
gctcctgtctgcctgcgggggggctctgggcaggggtagcctgggcatctcagccctgccctggttgtgggcggccagcgagcccagtgtctgcctctgtcccgagcctctggtcccctgggactaggttagtgccccctcatctgggtgcagagacagtgggtgcatcctggtagcatgcctttatcggggagtgggtgtgagggaaggcggggaccgctggcaggtggaggggcagtatggttccaggacccactcccggtagttctgggtggtgccgggcgggcgctggggtgccgacagggagggcacgtagtctgatgccctccacagtggctccaccccgtaccggttcctgttgagcactgtaggtgggactcgggtcaccatgtgcccccacctcctcgccgttggccagcaaggggctcctggatcgccccgggcagtttcaccctggcctaggtggccttgtccccctggcctcccaaggacccaccctgcacctagcctcaccgtattccttgccccggattggcctgtctttccacagcgcgctcccccaccgggtgctgggggcctggtactgggcagggacgatggggtcatgccaggcggtctcccgcaggtgctgggtgtaggctgcggtggggcgggggctggcggtcattcctgtccccctctggcaggcccgctgcccagggcgggggggggggcactcacccgatggcatgctgcactcacggtgttggtagcagctgtgccagcggttgtaggcctcgcggaaggggctggccggggcccgtggcaggttgtaccaggcttcccaggcgtccgagttggtcaggcctgtgtaccacagctggccggctgcgtcccgtcccatgggcgtgtacttccagcgtgtggcctgcctgatggctggtggccagcgggaaccctccagggacaggtagtcatcgctgagggtgggcagggggcagagactgagcccatgtctacagcgagtgctttgacccctttgcgatgtctgccagggtggatgatgtagaggcctggcccacggcgtggggtctccctccctcgccacttggagtctg
